United States Patent
Brix et al.

(10) Patent No.: US 12,258,373 B2
(45) Date of Patent: Mar. 25, 2025

(54) **PANEL COMPRISING *BORRELIA* MHC MULTIMERS**

(71) Applicant: Immudex ApS, Virum (DK)

(72) Inventors: Liselotte Brix, Bagsværd (DK); Kivin Jacobsen, Copenhagen (DK); Amir Ameri, Vanløse (DK)

(73) Assignee: Immudex ApS, Virum (DK)

( * ) Notice: Subject to any disclaimer, the term of this patent is extended or adjusted under 35 U.S.C. 154(b) by 952 days.

(21) Appl. No.: 17/415,077

(22) PCT Filed: Dec. 17, 2019

(86) PCT No.: PCT/EP2019/085592
§ 371 (c)(1),
(2) Date: Jun. 17, 2021

(87) PCT Pub. No.: WO2020/127222
PCT Pub. Date: Jun. 25, 2020

(65) Prior Publication Data
US 2022/0064226 A1   Mar. 3, 2022

(30) Foreign Application Priority Data
Dec. 17, 2018 (EP) .................................. 18212880

(51) Int. Cl.
| | | |
|---|---|---|
| *A61K 47/61* | (2017.01) | |
| *A61K 39/02* | (2006.01) | |
| *A61K 49/14* | (2006.01) | |
| *A61P 31/04* | (2006.01) | |
| *C07K 14/20* | (2006.01) | |
| *C07K 14/74* | (2006.01) | |
| *G01N 15/1434* | (2024.01) | |
| *G01N 33/569* | (2006.01) | |
| *A61K 39/00* | (2006.01) | |
| *G01N 15/01* | (2024.01) | |
| *G01N 15/10* | (2006.01) | |

(52) U.S. Cl.
CPC .......... *C07K 14/20* (2013.01); *A61K 39/0225* (2013.01); *A61K 49/14* (2013.01); *A61P 31/04* (2018.01); *C07K 14/70539* (2013.01); *G01N 15/1434* (2013.01); *G01N 33/56911* (2013.01); *A61K 2039/572* (2013.01); *A61K 2039/605* (2013.01); *C07K 2319/33* (2013.01); *G01N 15/01* (2024.01); *G01N 2015/1006* (2013.01); *G01N 2333/20* (2013.01); *G01N 2333/70539* (2013.01)

(58) Field of Classification Search
None
See application file for complete search history.

(56) References Cited

U.S. PATENT DOCUMENTS

| | | |
|---|---|---|
| 4,281,061 A | 7/1981 | Zuk et al. |
| 4,336,173 A | 6/1982 | Ugelstad |
| 4,387,164 A | 6/1983 | Hevey et al. |
| 4,459,378 A | 7/1984 | Ugelstad |
| 4,654,267 A | 3/1987 | Ugelstad et al. |
| 4,876,190 A | 10/1989 | Recktenwald |
| 5,039,487 A | 8/1991 | Smith |
| 5,130,297 A | 7/1992 | Sharma et al. |
| 5,194,425 A | 3/1993 | Sharma et al. |
| 5,260,422 A | 11/1993 | Clark et al. |
| 5,284,935 A | 2/1994 | Clark et al. |
| 5,312,744 A | 5/1994 | Shibata |
| 5,468,481 A | 11/1995 | Sharma et al. |
| 5,583,031 A | 12/1996 | Stern |
| 5,627,037 A | 5/1997 | Ward et al. |
| 5,635,363 A | 7/1997 | Altman et al. |
| 5,652,342 A | 7/1997 | Zimmerman et al. |
| 5,807,552 A | 9/1998 | Stanton et al. |
| 5,869,270 A | 2/1999 | Rhode et al. |
| 5,891,741 A | 4/1999 | Siiman et al. |
| 5,955,079 A | 9/1999 | Mond et al. |
| 5,994,089 A | 11/1999 | Siiman et al. |
| 5,998,204 A | 12/1999 | Tsien et al. |
| 6,015,884 A | 1/2000 | Schneck et al. |
| 6,096,315 A | 1/2000 | Zimmerman et al. |
| 6,156,317 A | 5/2000 | Diamond et al. |
| 6,074,645 A | 6/2000 | Diamond et al. |
| 6,090,587 A | 7/2000 | Rhode et al. |
| 6,106,840 A | 8/2000 | Clark et al. |
| 6,129,916 A | 10/2000 | Chang |
| 6,140,113 A | 10/2000 | Schneck et al. |

(Continued)

FOREIGN PATENT DOCUMENTS

| | | |
|---|---|---|
| DE | 197 40 735 | 3/1999 |
| DE | 102 47 014 | 4/2004 |

(Continued)

OTHER PUBLICATIONS

U.S. Appl. No. 08/374,468, filed Jan. 18, 1995, Boehringer Mannheim.
Altman et al., "Formation of functional peptide complexes of class II major histocompatibility complex proteins from subunits produced in *Escherichia coli*," Proc. Natl. Acad. Sci. USA, pp. 10330-10334, Nov. 1993, vol. 90.
Altman et al., "Phenotypic Analysis of Antigen-Specific T Lymphocytes," Science 274:94-97, 1996.
Appel et al., "Anergy induction by dimeric TCR ligands," J. Immunol., pp. 5279-5285, Apr. 15, 2001, vol. 166.

(Continued)

*Primary Examiner* — Jennifer E Graser
(74) *Attorney, Agent, or Firm* — Verrill Dana, LLP

(57) ABSTRACT

Disclosed herein is a panel comprising one or more MHC multimers; and a panel comprising one or more pools of MHC multimers, wherein each pool comprises one or more MHC multimers; wherein said MHC multimers comprise an antigenic peptide P derived from a *Borrelia* antigenic polypeptide selected from the group consisting of OppA, DbpA, FlhF, FlaB and P37-42; as well as uses thereof in the detection of *Borrelia*-specific T cells and the diagnosis, treatment and monitoring of *Borrelia* disease in an individual.

15 Claims, 40 Drawing Sheets

Specification includes a Sequence Listing.

(56) References Cited

U.S. PATENT DOCUMENTS

| | | |
|---|---|---|
| 6,156,514 A | 12/2000 | Acevedo et al. |
| 6,197,302 B1 | 3/2001 | Hirsch et al. |
| 6,197,928 B1 | 3/2001 | Tsien et al. |
| 6,211,342 B1 | 4/2001 | Hirsch et al. |
| 6,232,445 B1 | 5/2001 | Rhode et al. |
| 6,248,564 B1 | 6/2001 | Walter et al. |
| 6,251,399 B1 | 6/2001 | Diamond et al. |
| 6,268,411 B1 | 7/2001 | Schneck et al. |
| 6,306,605 B1 | 10/2001 | Acevedo et al. |
| 6,309,645 B1 | 10/2001 | Rhode et al. |
| 6,335,173 B1 | 1/2002 | Kaplan |
| 6,387,622 B1 | 5/2002 | Siiman et al. |
| 6,448,071 B1 | 9/2002 | Schneck et al. |
| 6,451,314 B1 | 9/2002 | Clark et al. |
| 6,451,769 B1 | 9/2002 | Huebner et al. |
| 6,458,354 B1 | 10/2002 | Schneck et al. |
| 6,458,933 B1 | 10/2002 | Hansen |
| 6,486,130 B1 | 11/2002 | Livey et al. |
| 6,517,838 B1 | 2/2003 | Hook et al. |
| 6,534,633 B1 | 3/2003 | Weindanz et al. |
| 6,548,067 B1 | 4/2003 | Seeman et al. |
| 6,605,711 B1 | 8/2003 | Valmori et al. |
| 6,734,013 B2 | 5/2004 | Schneck et al. |
| 7,041,442 B1 | 5/2006 | Kern et al. |
| 7,060,869 B2 | 6/2006 | Tsien et al. |
| 7,064,190 B1 | 6/2006 | Endl et al. |
| 7,074,904 B2 | 7/2006 | Wong et al. |
| 7,094,555 B2 | 8/2006 | Kwok et al. |
| 7,116,407 B2 | 10/2006 | Hansen et al. |
| 7,141,656 B2 | 11/2006 | Rhode et al. |
| 7,202,349 B2 | 4/2007 | Davis et al. |
| 7,364,869 B2 | 4/2008 | Nixon et al. |
| 7,502,580 B2 | 3/2009 | Hays |
| 7,519,318 B2 | 4/2009 | Kurogawa et al. |
| 7,524,503 B2 | 4/2009 | Khanna et al. |
| 7,706,782 B1 | 4/2010 | Hosmer et al. |
| 7,902,121 B2 | 3/2011 | Chen et al. |
| 8,114,669 B2 | 2/2012 | Choo |
| 8,268,964 B2 | 9/2012 | Scholler et al. |
| 8,298,782 B2 | 10/2012 | Busch et al. |
| 2002/0006903 A1 | 1/2002 | Schneck et al. |
| 2002/0034513 A1 | 3/2002 | Rhode et al. |
| 2002/0058787 A1 | 5/2002 | Strominger et al. |
| 2002/0082411 A1 | 6/2002 | Carter et al. |
| 2002/0091079 A1 | 7/2002 | Rhode et al. |
| 2002/0119149 A1 | 8/2002 | Jakobsen et al. |
| 2002/0127231 A1 | 9/2002 | Schneck et al. |
| 2002/0164340 A1 | 11/2002 | Brumeanu et al. |
| 2002/0165364 A1 | 11/2002 | Tsien et al. |
| 2002/0198144 A1 | 12/2002 | Wong et al. |
| 2003/0017447 A1 | 1/2003 | Bernardo et al. |
| 2003/0073102 A1 | 4/2003 | Kwok et al. |
| 2003/0096432 A1 | 5/2003 | Jakobsen |
| 2003/0104635 A1 | 6/2003 | Jakobsen |
| 2003/0118594 A1 | 6/2003 | Nag et al. |
| 2003/0171290 A1 | 9/2003 | Carr et al. |
| 2003/0199438 A1 | 10/2003 | Shaw et al. |
| 2003/0228258 A1 | 12/2003 | Scheinberg et al. |
| 2004/0068100 A1 | 4/2004 | Mach et al. |
| 2004/0072262 A1 | 4/2004 | Montero-Julian et al. |
| 2004/0082012 A1 | 4/2004 | Busch et al. |
| 2004/0086520 A1 | 5/2004 | Diamond |
| 2004/0137642 A1 | 7/2004 | Erfle et al. |
| 2004/0141958 A1 | 7/2004 | Steinaa et al. |
| 2004/0143094 A1 | 7/2004 | Donda et al. |
| 2004/0204565 A1 | 10/2004 | Schneck et al. |
| 2004/0209295 A1 | 10/2004 | Schwabe et al. |
| 2004/0209314 A1 | 10/2004 | Lang et al. |
| 2004/0223977 A1 | 11/2004 | Diamond |
| 2004/0253632 A1 | 12/2004 | Rhode et al. |
| 2005/0003431 A1 | 1/2005 | Wucherpfennig et al. |
| 2005/0074822 A1 | 4/2005 | Nixon et al. |
| 2005/0074848 A1 | 4/2005 | Schwabe |
| 2005/0079152 A1 | 4/2005 | Bot et al. |
| 2005/0095655 A1 | 5/2005 | Montero-Julian et al. |
| 2005/0208529 A1 | 9/2005 | Winther et al. |
| 2005/0214284 A1 | 9/2005 | Price-Schiavi et al. |
| 2005/0214852 A1 | 9/2005 | Gaynor et al. |
| 2005/0239160 A1 | 10/2005 | Shaw et al. |
| 2006/0018878 A1 | 1/2006 | Cooper et al. |
| 2006/0018929 A1 | 1/2006 | Zaia et al. |
| 2006/0073159 A1 | 4/2006 | Vonderheide et al. |
| 2006/0078563 A1 | 4/2006 | Srivastava |
| 2006/0084116 A1 | 4/2006 | Muchhal |
| 2006/0112440 A1 | 5/2006 | Tsien et al. |
| 2006/0141540 A1 | 6/2006 | Miltenyi et al. |
| 2006/0155115 A1 | 7/2006 | Jakobsen et al. |
| 2006/0166214 A1 | 7/2006 | Kato et al. |
| 2006/0166875 A1 | 7/2006 | Jakobsen et al. |
| 2006/0171954 A1 | 8/2006 | Endl et al. |
| 2006/0228758 A1 | 10/2006 | Muchhal et al. |
| 2006/0228759 A1 | 10/2006 | Muchhal et al. |
| 2006/0234309 A1 | 10/2006 | Shankar et al. |
| 2006/0234310 A1 | 10/2006 | Cai et al. |
| 2006/0240482 A1 | 10/2006 | Kwok et al. |
| 2007/0026503 A1 | 2/2007 | Lacey |
| 2007/0134814 A1 | 6/2007 | Kajander et al. |
| 2007/0154953 A1 | 7/2007 | Brunner et al. |
| 2007/0178532 A1 | 8/2007 | Jacobson et al. |
| 2007/0184022 A1 | 8/2007 | Wang et al. |
| 2007/0280957 A1 | 12/2007 | Falk et al. |
| 2008/0219947 A1 | 9/2008 | Linette et al. |
| 2009/0004213 A1 | 1/2009 | Singh et al. |
| 2009/0061478 A1 | 3/2009 | Poulsen et al. |
| 2009/0232766 A1 | 9/2009 | Wang et al. |
| 2009/0324630 A1 | 12/2009 | Jensen |
| 2010/0159594 A1 | 6/2010 | Hansen et al. |
| 2012/0020998 A1 | 1/2012 | Plumas et al. |

FOREIGN PATENT DOCUMENTS

| | | |
|---|---|---|
| EP | 0 106 873 | 5/1984 |
| EP | 0 352 761 | 1/1990 |
| EP | 0 516 953 | 12/1992 |
| EP | 0 633 028 | 1/1995 |
| EP | 0 636 696 | 2/1995 |
| EP | 0 420 913 | 11/1995 |
| EP | 0 423 201 | 6/1996 |
| EP | 0 742 014 | 11/1996 |
| EP | 0 949 508 | 10/1999 |
| EP | 0946592 | 10/1999 |
| EP | 1023319 | 8/2000 |
| EP | 0 776 339 | 10/2000 |
| EP | 1 051 619 | 11/2000 |
| EP | 1181313 | 2/2002 |
| EP | 0 981 747 | 7/2002 |
| EP | 1 227 321 | 7/2002 |
| EP | 0 630 255 | 12/2002 |
| EP | 0 812 331 | 5/2004 |
| EP | 0 935 607 | 7/2004 |
| EP | 1 437 366 | 7/2004 |
| EP | 0 877 760 | 9/2004 |
| EP | 1 526 141 | 8/2005 |
| EP | 0 997 477 | 3/2006 |
| EP | 1 017 799 | 3/2006 |
| EP | 1 349 569 | 4/2007 |
| EP | 0 665 289 | 5/2007 |
| EP | 1 012 320 | 10/2007 |
| RU | 2 260 047 | 4/2005 |
| WO | WO 89/12458 | 12/1989 |
| WO | WO 89/12459 | 12/1989 |
| WO | WO 90/04411 | 5/1990 |
| WO | WO 91/09870 | 7/1991 |
| WO | WO 91/15766 | 10/1991 |
| WO | WO 92/00055 | 1/1992 |
| WO | WO 92/08983 | 5/1992 |
| WO | WO 92/18150 | 10/1992 |
| WO | WO 92/21972 | 12/1992 |
| WO | WO 93/01498 | 1/1993 |
| WO | WO 93/04175 | 3/1993 |
| WO | WO 93/08306 | 4/1993 |
| WO | WO 93/10220 | 5/1993 |
| WO | WO 94/11078 | 5/1994 |
| WO | WO 94/12196 | 6/1994 |

(56) References Cited

FOREIGN PATENT DOCUMENTS

| | | |
|---|---|---|
| WO | WO 95/11998 | 5/1995 |
| WO | WO 95/12676 | 5/1995 |
| WO | WO 95/14781 | 6/1995 |
| WO | WO 96/04314 | 2/1996 |
| WO | WO 96/26962 | 9/1996 |
| WO | WO 97/05239 | 2/1997 |
| WO | WO 97/28191 | 8/1997 |
| WO | WO 97/35991 | 10/1997 |
| WO | WO 97/42221 | 11/1997 |
| WO | WO 97/44667 | 11/1997 |
| WO | WO 98/03552 | 1/1998 |
| WO | WO 98/05965 | 2/1998 |
| WO | WO 98/06749 | 2/1998 |
| WO | WO 98/05684 | 5/1998 |
| WO | WO 1999/002183 | 1/1999 |
| WO | WO 99/11661 | 3/1999 |
| WO | WO 99/11775 | 3/1999 |
| WO | WO 99/14236 | 3/1999 |
| WO | 1999024577 A1 | 5/1999 |
| WO | WO 99/21572 | 5/1999 |
| WO | WO 99/13095 | 7/1999 |
| WO | WO 1999/36568 | 7/1999 |
| WO | WO 99/42597 | 8/1999 |
| WO | WO 99/50637 | 10/1999 |
| WO | WO 99/58557 | 11/1999 |
| WO | WO 99/60119 | 11/1999 |
| WO | WO 2000/006745 | 2/2000 |
| WO | WO 2000/015665 | 3/2000 |
| WO | 2000021989 A1 | 4/2000 |
| WO | WO 2000/023053 | 4/2000 |
| WO | WO 2000/075180 | 12/2000 |
| WO | WO 2000/078966 | 12/2000 |
| WO | WO 2003/000720 | 1/2001 |
| WO | WO 2001/63286 | 8/2001 |
| WO | 2001073443 A3 | 10/2001 |
| WO | WO 2001/72782 | 10/2001 |
| WO | WO 2001/072782 | 10/2001 |
| WO | WO 2001/070245 | 11/2001 |
| WO | WO 2001/080833 | 11/2001 |
| WO | WO 2001/090198 | 11/2001 |
| WO | WO 2001/090747 | 11/2001 |
| WO | WO 2002/016422 | 2/2002 |
| WO | WO 2002/054065 | 7/2002 |
| WO | WO 2002/072631 | 9/2002 |
| WO | WO 2002/089837 | 11/2002 |
| WO | WO 03/016905 | 2/2003 |
| WO | WO 2002/055992 | 3/2003 |
| WO | WO 2003/073097 | 9/2003 |
| WO | WO 2002/083906 | 10/2003 |
| WO | WO 2003/101473 | 12/2003 |
| WO | WO 2004/000873 | 12/2003 |
| WO | WO 2004/014957 | 2/2004 |
| WO | WO 2004-018520 | 3/2004 |
| WO | WO 2004-033497 | 4/2004 |
| WO | WO 2004/093905 | 11/2004 |
| WO | 2005003394 A2 | 1/2005 |
| WO | WO 2005/002621 | 1/2005 |
| WO | WO 2005/007689 | 1/2005 |
| WO | WO 2005/035567 | 4/2005 |
| WO | WO 2005/049073 | 6/2005 |
| WO | WO 2005/116051 | 12/2005 |
| WO | WO 2006/009838 | 1/2006 |
| WO | WO 2006/014292 | 2/2006 |
| WO | WO 2006/056027 | 6/2006 |
| WO | WO 2006/071990 | 7/2006 |
| WO | WO 2006/081826 | 8/2006 |
| WO | WO 2006/082387 | 8/2006 |
| WO | WO 2006/090283 | 8/2006 |
| WO | WO 2006/113622 | 10/2006 |
| WO | 2007015168 A2 | 2/2007 |
| WO | WO 2007/065098 | 6/2007 |
| WO | WO 2007/085266 | 8/2007 |
| WO | WO 2007/136778 | 11/2007 |
| WO | WO 2008/019366 | 2/2008 |
| WO | WO 2008/031133 | 3/2008 |
| WO | WO 2008/116468 | 10/2008 |
| WO | WO 2009/003492 | 1/2009 |
| WO | WO 2009/003493 | 1/2009 |
| WO | WO 2009/039854 | 4/2009 |
| WO | WO 2009/106073 | 9/2009 |
| WO | WO 2009/114207 | 9/2009 |
| WO | 2009126828 A2 | 10/2009 |
| WO | WO 2009/125231 | 10/2009 |
| WO | WO 2009/126816 | 10/2009 |
| WO | WO 2009/155535 | 11/2009 |
| WO | WO 2010/009735 | 1/2010 |
| WO | WO 2010/032022 | 3/2010 |
| WO | WO 2010/037395 | 4/2010 |
| WO | WO 2010/037397 | 4/2010 |
| WO | WO 2010/037402 | 4/2010 |
| WO | 2013116668 A2 | 8/2013 |
| WO | 2015185067 A1 | 12/2015 |
| WO | 2015188839 A2 | 12/2015 |

OTHER PUBLICATIONS

Appel et al., "Kinetics of T-cell receptor binding by bivalent HLA-DR-peptide complexes that activate antigen-specific human T-cells," J. Biol. Chem., pp. 312-321, Jan. 7, 2000, vol. 275.

Andersen et al., "Spontaneous cytotoxic T-cell responses against survivin MHC class I-restricted T-cell epttopes in situ as well as ex vivo in cancer patients," Cancer Res., vol. 61, pp. 5964-5968, 15, 2001.

Ausubel et al., "Characterization of in vivo expanded OspA-specific human T-cell clones," Clinical Immunology, Academic Press, pp. 313-322, Jun. 1, 2005 (Jun. 1, 2005), vol. 115, No. 3.

Bakker et al., "MHC multimer technology: Current status and future prospects," Current Opinion in Immunology, 17:428-433, 2005.

Barany et al., "Solid-phase peptide synthesis: A silver anniversary report," Int. J. Peptide Protein Res., 30:705-739, 1987 (Abstract Only).

Batard et al., "Dextramers: New generation of fluorescent MHC class I-peptide multimers for visualization of antigen-specific CD8<+> T cells," Journal of Immunological Methods, Elsevier Science Publishers, pp. 136-148, Mar. 20, 2006 (Mar. 20, 2006), vol. 310, No. 1-2.

Berger et al., "Circulation and hoimg of melanoma-reactive T cells to both cutaneous and visceral metastases after vaccinnation with monocyte-derived dendritic cells," Int. J. Cancer, pp. 229-237, 2004, vol. 111.

Bergmeier et al., "Innate and adoptive mucosal immunity in protection against HIV infection," Advances in Dental Research 2006, pp. 21-28, 2006, vol. 19, No. 1, XP002562924.

Bill et al., "Use of soluble MHC class II-peptide multimers to detect antigen-specific T cells in human disease," Arthritis Res., pp. 261-265, Feb. 28, 2002, vol. 4.

Bjorkman et al., "The foreign antigen binding site and T cell recognition regions of class I histocompatibility antigen," Nature 329:512-518, 1987.

Bogers, "CCR5 targeted SIV vaccination strategy preventing or inhabiting SIV infection," Vaccine, Butterworth Scientific, pp. 2974-2984, 13 2004 (Aug. 13, 2004), vol. 22, No. 23-24. Guildford, GB.

Burlingham et al., "Soluble MHC, Immunoregulation, and tolerance: A progress report," Human Immunol., pp. 1316-1319, Dec. 2000, vol. 61.

Callan et al., "Direct Visualizing of Antigen.specific CD8+ T Cells during th ePRimary Immune Response to Epstein-Barr Virus in Vivo," J. Exp. Med., May 1998, pp. 1395-1402, vol. 187, No. 9.

Cameron et al., "Labeling antigen-specific DC4(+) T cells with class II MHC oligomers," J. Immunol. Methods, pp. 51-69, Oct. 1, 2002, vol. 268.

Carena et al., "Major Histocompatibility Complex Class I Molecules Modulate Activation Threshold and Early Signaling of T-Cell Antigen Receptor-γδ Stimulated by Nonpeptidic Ligands," J. Exp. Med., Nov. 17, 1997, pp. 1769-1774, 186 (10).

Casares et al., "Antigen-specific downregulation of T cells by doxorubicin delivered through a recombinant MHC II-peptide chimera," Nature Biotech., pp. 142-147, Feb. 2001, vol. 19.

Cochran et al., "Receptor clustering and transmembrane signaling T cells," TIBS, pp. 304-310, May 2001, vol. 26 (Abstract Only).

(56) References Cited

OTHER PUBLICATIONS

Coles et al., "Memory CD8 T lymphocytes express inhibitory MHC-specific Ly49 receptors," Eur. J. Immunol. 30:236-244, 2000.
Constantin et al., "Major histocompatibility complex (MHC) tetramer technologt: An evaluation," Biol. Res. Nursing, pp. 115-127, Oct. 2002, vol. 4.
Dal Porto et al, "A soluble divalent class I major histocompatibility complex molecule inhibits alloreactive T cells at nanomolar concentrations," Porc. Natl. Acad. Sci. 90.6671-6675, 1993.
Dako: "MHC Dextramers" Internet Article Jul. 6, 2006 URL: pri.dako.com-00207_mhcdex_0406.pdf.
Devito-Haynes et al., "Soluble donor HLA class I and β2-m-free heavy chain in serum of lung transplant recipients: Steady-state levels and increases in patients with recurrent CMV infection, acute rejection episodes, and poor outcome," Human Immunol., pp. 1370-1382, Dec. 2000, vol. 61.
Drouin et al., "Searching for borrelial T-cell epitopes associated with antibiotic-refractory Lyme arthritis," Molecular Immunology, pp. 2323-2332, Jan. 11, 2008 (Jan. 11, 2008), vol. 45, No. 8, GB.
Ed. Charron, "HLA: Genetic diversity of HLA. Functional and Medical Implication," EDK Press, pages corresponding to Tables 1A and 1B, 1997.
Erout et al., "Preparation of Conjugates between Oligonucleotide and N-Vinylpyrrolidone-N-Acryoxysuccinimide Coplymers and Applications in Nucleic Acid Assays to Improve Sensitivity," Bioconjugate Chem. 1996, pp. 568-575, vol. 7.
Fields et al., "Solid phase peptide synthesis utilizing 9-fluorenylmethoxycarbonyl amino acids," Int. J. Peptide Res., 353:161-214, 1990 (Abstract Only).
Frayser et al., "Empty and peptide-loaded class II major histocompatibility complex proteins produced by expression in *Escherichia coli* and folding in vitro," Protein Expression and Purification, pp. 105-114, Feb. 1999, vol. 15 (Abstract Only).
Garboczi et al., "HLA-A2.peptide complexes: Refolding and crystallization of molecules expressed in *Escherichia coli* and complexed with single antigenic peptides," Proc. Natl. Acad. Sci., 89:3429-3433, 1992.
Gordon et al., "Applications of Combinatorial Technologies to Drug Discovery. 2. Combinatorial Organic Synthesis, Library Screening Strategies, and Future Directions," Journal of Medicinal Chemistry, 37 (10):1385-1401, 1994 (Abstract Only).
Haanen et al., "In situ detection of virus- and tumor-specific T-cell Immunity," Nature Medicine, Sep. 2000, pp. 1056-1060, vol. 6 (Abstract Only).
Hadrup et al., "Persistence of survivin specific T cells for seven years in a melanoma patient during complete remission," Cancer Biol. Ther., pp. 480-482, May 2006, vol. 5.
Houghten et al., "Generation and use of synthetic peptide combinatorial libraries for basic research and drug discovery," Nature, 354:84-86, 1991 (Abstract Only).
Huges et al., "Generation and use of alternative multimers of peptide-MHC complexes," Journal of Immunological Methods, 268:83-92, 2002.
Jung et al., "Multiple Peptide Synthesis Methods and their Applications," Angewandte Chemie, 31 (4):367-486, 1992 (Abstract Only).
Kalandadze et al., "Expression of Recombinant HLA-DR2 molecules," J. Biol. Chem., pp. 20156-20162, 16, 1996, vol. 271.
Knabel et al., "Reversible MHC multimer staining for functional isolation of T-cell populations and effective adoptive transfer," Nature Medicine, Nature Publishing Group, pp. 631-637, Jun. 1, 2002 (Jun. 1, 2002), vol. 8, No. 6.
König, "Interactions between MHC molecules and co-receptors of the TCR," Current Opinion in Immunology, pp. 75-83, 2002, vol. 14.
Kozono et al., "Production of soluble MHC class II proteins with covalently bound single peptides," Nature, pp. 151-154, May 12, 1994, vol. 369 (Abstract Only).
Kuroda et al., "Analysis of Gag-specific Cytotoxic T Lymphocytes in Simian Immunodeficiency Virus-intected Rhesus Monkeys by Cell Staining with Tetrameric Major Histocompatibility Complex Class I-Peptide Complex," J.Exp. Med., May 4, 1998, 1373-1381, vol. 187, No. 9.
Kuttler et al., "An Algorithm for the Prediction of Proteasomal Cleavages," J. Miol. Biol., 298:417-429, 2000.
Larsson, "Immunocytochemical detection systems," in Immunocytohemistry: Theory and Practice, pp. 77-145, CRC Press, 1988.
Lee et al., "Characterizatio of circulating T cells specific for tumor-associateda ntigens in melanoma patients," Nature Medicine, Jun. 1999, pp. 677-685, vol. 5, No. 6.
Lehner, "Allomicrovac: A combined microbicidal-immunising strategy against SIV and HIV infection," Vaccines for Humans, pp. 64-65, Dec. 5, 2008 (Dec. 5, 2008), XP0025629223, URL: http:--www.biblioteca.porto.ucp.pt-docbweb-MULTIMEDIA-ASSOCIA-PDF-VAC.PDF.
Ljunggren et al., "Empty MHC class I molecules come out in the cold," Nature 346:476-480, 1990.
Mallone et al., "MHC class II tetramers and the pursuit of antigen-specific T cells: Define, deviate, delete," Clin. Immunol., pp. 232-242, 2004, vol. 110.
Marchand et al., "Tumor regression responses in melanoma patients treated with a peptide encoded by gene MAGE-3," Int. J. Cancer, 63:883-885, 1995.
Matsumura et al., "Emerging Principles for the Recognition of Peptide Antigen by MHC class I Molecules," Science 257:927-934, 1992.
Matsumura et al., "In vitro peptide binding to soluble empty calss I major histocompatibility complex molecules isolated from transfected *Drosophila melanogaster* cells," J. Biol. Chem., pp. 23589-23595, Nov. 25, 1992, vol. 267.
McCluskey et al., "T-cell activation by purified, soluble , class I MHC molecules: Requirement for polyvalency," *J. Immunol.* 141(5):1451-55, 1988.
McHeyzer-Williams et al., "Tracking antigen-specific helper T cell responses," Current Opinion in Immunology, pp. 278-284, 1996, vol. 8.
Merrifield et al., "Instrument for Automated Synthesis of peptides," Analytical Chemistry, 38 (13):1905-1914, 1966 (Abstract Only).
Merrifield, "Solid Phase Synthesis," Science 232:341-347, 1986 (Abstract Only).
Meyer et al., "Direct enumeration of Borrelia-reactive CD4 T-cell ex vivo by using MHC class II tetramers," Proceedings of the National Academy of Sciences of USA. (PNAS), National Academy of Science, pp. 11433-11438, Oct. 10, 2000 (Oct. 10, 2000), vol. 97, No. 21, Washington D.C., US.
Mutis et al., "Tetrameric HLA class I-minor histocompatability antigen peptide complexes demnstrate minor histocompatibility antigen-specific cytoxic T lymphocytes in patients with graft-visus-host disease," Nature Medicine, Jul. 1999, pp. 839-842, vol. 5, No. 7.
Neudorfer et al., "Reversible HLA multimers (streptamers) for the isolation of human cytotoxic T lymphocytes functionally active against tumor- and virus-derived antigens," Journal of Immunological Methods, 320:119-131, 2007.
O'Herrin et al., "Analysis of the Expression of Peptide-Major Histocaompatibility Complexes using high affinity Soluble Divalent T-Cell Receptors," The Journal of Biological Chemistry, Oct. 20, 1997, pp. 1333-1345, vol. 186, No. 8.
Reich et al., "Stability of empty and peptide-loaded class II major histocompatibility complex molecules at neutral and endosomal pH: Comparison to class I proteins," Proc. Natl. Acad. Sci. USA, pp. 2495-2500, Mar. 1997, vol. 94.
Reijonen et al., "Use of HLA class II tetramers in tracking antigen-specific T cell and mapping T-call epitopes," pp. 282-288, 2003, vol. 29.
Scheirle et al., "Peptide binding to soluble HLA-DR4 molecules produced by insect cells," J. Immunol., pp. 1994-1999, Sep. 15, 1992, vol. 149 (Abstract Only).
Scheffold et al., "Recent Development in Flow Cytometry," Journal of Clinical Immunology, 2000, vol. 20, No. 6.
Sengupta et al., "Heat shock protein-mediated cross-presentation of exogenous HIV antigen on HLA class I and class II," Journal of

(56) References Cited

OTHER PUBLICATIONS

Immunology, American Association of Immunologists, pp. 1987-1993, 1 2004 (Aug. 1, 2004), vol. 173, No. 3.
Shambrook, Fritsch and Maniatis, "Molecular Cloning," Cold Spring Harbor Press, 1989, Index and Table of Contents pp. xi to xxxviii and I-1 to I-47.
Shields et al., "The Effect of Human β2-Microglobulin on Major Histocompatibility Complex I Peptide Loading and the Engineering of a High Affinity Variant," The Journal of Biological Chemistry, Oct. 23, 1998, pp. 28010-28018, vol. 273, No. 43.
Siiman et al., Bioconjugate Chem. 1999, pp. 1090-1106.
Skinner et al., "In situ tetramer staining," J. Immunol. Meth., pp. 29-34, 2002, vol. 268.
Sørensen et al., "Efficient tumor cell lysis mediated by a bcl-X(L) specific T cell clone isolated from a breast cancer patient," Cancer Immunology, Immunotherapy, Springer, pp. 527-533, Jul. 19, 2006 (Jul. 19, 2006), vol. 56, No. 4.
Stern et al., "The human class II MHC protein HLA-DR1 assembles as empty alpha beta heterodimers in the absence of antigenic peptide," Cell, pp. 465-477, Feb. 7, 1992, vol. 68 (Abstract Only).
Stratmann et al., "Susceptible MHC Alleles, not background genes, select an autoimmune T cell reactivity," The Journal of Clinical Investigation, pp. 902-914, Sep. 2003, vol. 112, No. 6.
Stöckel et al., "Refolding of human class II major histocompatibility complex molecules isolated from *Escherichia coli*", J. Biol. Chem., pp. 29571-29578, Nov. 25, 1994, vol. 269.
Sun et al., "MHC class I multimers," Arthritis Res., pp. 265-269, Jul. 2001, vol. 3.
Ugolini et al., "Regulation of T cell function by NK cell receptors for classical MHC class I molecules," Current Opinion in Immunology 12:295-300, 2000.
Valmori et al., "Enhanced generation of specific tumor-reactive CTL in vitro by selected Melan-A-MART-1 immunodominant peptide analogues," J. Immunol., pp. 1750-1758, Feb. 15, 1998, vol. 160.
Viola et al., "T-cell activation and the dynamic world of rafts.," APMIS 107:615-623, 1999.
Vyth-Dreese et al., "In situ visualization of antigen specific T cells in cryopreserved human tissues," J. Immunol. Meth., pp. 78-85, 2006, vol. 310.
White et al., "Soluble class I MHC with β2-microglobulin covalently linked peptides: Specific binding to a T cell hybridoma," J. Immunol., pp. 2671-2676, Mar. 1, 1999, vol. 162.
Xu et al., "MHC-peptide tetramer-based studies of T cell function," J. Immunol Meth., pp. 21-28, 2002, vol. 268.
Zhang et al., "Essential role of LAT in T cell development," Immunity 10:323-332, 1999.
Alp, et al.. "Fine specificity of cellular immune responses in humans to human cytomegalovirus immediate-early 1 protein", Journal of Virology, vol. 65, No. 9, 1991 pp. 4812-4820.
Bleesing. et al.. "Cell Function-Based Flow Cytometry" Seminars in Hematology, Apr. 2001, pp. 169-178, vol. 38, No. 2.
Bross, et al., "Approval summary: Gemtuzumab ozogamicin in relapsed acute myeloid leukemia". Clin. Cancer Res., 2001, 7:1490-1496.
Cecconi, et al.. "Use of MHC Class II Tetramers to Investigate CD4-T Cell Responses: Problems and Solutions," Cytometry, 2008, Part A 73, No. 11, pp. 1010-10018.
Chattopadhyay, et al.."Techniques to improve the direct Ex Vivo detection of low frequency antigen-specific CD8+T cells with peptide-major histocompatibility complex class I tetramers,"Cytometry. 2008. Part A, vol. 73, pp. 1001-1009.
Drouin. et al., "Molecular Characterization of the OspA161-175 T cell epitope associated with the treatment-resistant Lyme Arthritis: difference among the three pathogenic species of *Borrelia burgdorferu* sensu lato", Journal of Autoimmunology. 2004. vol. 23. No. 3. pp. 281-292.
Ferré, et al.. "Purification of correctly oxidized MHC class I heavy-chain molecules under denaturing conditions: A novel strategy exploiting disulfide assisted protein folding", Protein Science, 2003, 12, pp. 551-559.

Fornas et al., Flow Cytometry Counting of CD34-cells in whole blood. Nature Medicine, 6 (2000) 7:833-836.
Heijnen, et al., "Enumeration of Antigen-Specific CD8-T Lymphocytes by Single-Platform. HLA Tetramer-Based Flow Cytometry: A European Multicenter Evaluation", Clinical Cytometry, 2004, pp. 1-13, vol. 62B.
International Search report mailed May 6, 2007 in International Application No. PCT/DK2007/000045.
Lissina, et al., "Protein Kinase Inhibitors Substantially Improve the Physical Detection of T-Cells with Peptide-MHC Tetramers," J. Immunol. Methods, 2009, vol. 340, pp. 11-24.
Maloney, et al., "IDEC-C2B8 (Rituximab) anti-CD20 monoclonal antibody therapy in patients with relapsed low-grade non-Hodgkin's lymphoma," Sep. 1997. Blood, 90 (6):21:88-2195.
Melenhorst, et al.,"Detection of Low Avidity CD8-T Cell Populations with Coreceptor-Enhanced Peptide-Major Histompatibility Complex Class I Tetramers," j. Immunol. Methods, 2008. vol. 338. No. 1-2. pp. 31-39.
Vollers, et al., "Class II Major Histocompatibility Complex Tetramer Staining: Progress, Problems, and Prospects." Immunology. 2008, vol. 123, pp. 305-313.
Weichsel, et al. ,"Profound Inhibition of Antigen-Specific T-Cell Effector Functions by Dasatinib," Clin. Cancer Res.2008. vol. 14. pp. 2484-2491.
Wolfl. et al.. "Quantitation of MHC Tetramer-Positive Cells From Whole Blood: Evaluation of Single-Platform, Six-parameter Flow Cytometric Method", Cytometry Part A, 2004, pp. 120-130, vol. 57A.
Andersen et al., "Parallel detection of antigen-specific T-cell responses by combinatorial encoding of MHC multimers," Nature Protocols (2012), vol. 7, No. 5, pp. 891-902.
Bauer, Maximizing Immune Responses: The Effects of Covalent Peptide Linkage to Beta-2-Microglobulin, Oncology Research, vol. 17, pp. 205-216 (2008).
Cortez-Gonzales, Immunogenic HLA-B7-restricted peptides of hTRT. Intl Immunology, vol. 18 No. 12 pp. 1707-1718 (2006).
Desrosiers, "Prospects for an AIDS vaccine," Nature Medicine, vol. 10, No. 3, (2004).
Greten, "Peptide-beta-2-microglubulin-MHC fusion molecules bind antigen-specific T cells and can be used for multivalent MHC-Ig complexes," J. Immunological Methods, 271,pp. 125-135 (2002).
Hackett, "Frontiers in peptide-MHC class II multimer technology," Nature Immunology, vol. 3, No. 10 (2002).
Lauritsen, Two distinct pathways exist for down-regulation of the TCR, J, Immunology, 161:260-7 (1998).
Matthews, et al., "Prospects for Development of a Vaccine Against HTLV-III-Related Disorders," AIDS Research and Human Retroviruses, vol. 3 Supplement I, (1987), pp. 197-206.
Nikolich-Zugich, "The many important facets of t-cell repertoire diversity. Nature Reviews Immunology," vol. 4, 123-132 (2004).
Oka, "Induction of WT1 (Wilms' tumor gene)-specific cytotoxic T lymphocytes by WT1 peptide vaccine and the resultant cancer regression," PNAS, vol. 101 No. 38, 13885-13890 (2004).
Rammensee, "MHC ligands and peptide motifs: first listing. Immunogenetics," 41:178-228 (1995).
Hadrup, "Parallel detection of antigen-specific T-cell responses by multidimensional encoding of MHC multimers", Nature Methods (Nature Publishing Group), Basingstoke GB, vol. 6, No. 7, doi:10.1038/NMETH.1345, ISSN 1548-7091, pp. 520-528, (2009).
Schroers, "Identification of HLA DR7-restricted epitopes from human telomerase reverse transcriptase recognized by CD4+ T-helper cells," Cancer Research 62, 2600-2605, (2002).
Speiser, In Vivo Activation of Melanoma-Specific CD8(+) T Cells by Endogenous Tumor Antigen and Peptide Vaccines. A Comparison to Virus-Specific T Cells, Eur. J. Immunol. 32: 731-741 (2002).
Stoeva, "Multiplexed Detection of Protein Cancer Markers with Biobarcoded Nanoparticle Probes", J. American Chemical Society, vol. 128, No. 26, doi:10.1021/JA0613106, ISSN 0002-7863, pp. 8378-8379, (2006).
Sano, "Immuno-PCR: Very sensitive antigen detection by means of specific antibody-DNA conjugates," Science American Association for the Advancement of Science, UA, vol. 258, No. 5079, 120-122 (1992).

(56) References Cited

OTHER PUBLICATIONS

Xu, "Preparation and Characterization of HLA-A *0201 Tretamer Loaded with IE-1 316-324 Antigenic Peptide of Human Cytomegalovirus," Cullular & Molecular Immunology, vol. 3, No. 5, pp. 367-371 (2006).
Yang et al. "Immunization with recombinant macaque major histocompatibility complex class I and II and human immunodeficiency virus gp140 inhibits simian-human immunodeficiency virus infection in macaques," Journal of General Virology, vol. 93, pp. 1506-1518 (2012).
Le Doussal et al., "Phage display of peptide/major histocompatibility complex", Journal of Immunological Methods, vol. 241, issues 1-2, 31, pp. 147-158, 2000.
Seneci, Pierfausio, "Encoding Techniques for Pool Libraries of Small Organic Molecules", Journal of Receptors and Signal Transduction, vol. 21, 2001—Issue 4. pp. 409-445. doi.org/10.1081/RRS-100107925.
Akiyama, "Analysis of HLA-A24-restricted CMVpp65 peptide-specific CTL with HLA-A*2402-CMVpp65 tetramer," Immunology Letters, vol. 95, Issue 2, pp. 199-205 (2004).
HLA Nomenclature (2015), "HLS Alleles Numbers", Retrieved from hla.alleles.org on Mar. 17, 2015, Two pages.
Celis, "Identification of potential CTL Epitopes of Tumor-Associated Antigen Mage-1 for Five Common HLA-A Alleles," Molecular Immunology, vol. 31, No. 18, pp. 1423-1430 (1994).
Chen, "Modulation of CD1d-restricted NKT cell responses by CD4," Journal of Leukocyte Biology, vol. 82, pp. 1455-1465 (2007).
Dibrino, "Endogenous peptides bound to HLA-A3 possess a specific combination of anchor residues that permit identification of potential antigenic peptides," Proc. Natl. Acad. Sci. USA, vol. 90, pp. 1508-1512 (1993).
Drake, "Cutting Edge: Lipid Raft Integrity Affects the Efficiency of MHC Class I Tetramer Binding and Cell Surface TCR Arrangement on CD8+ T Cells," The Journal of Immunology, vol. 166, No. 12, pp. 7009-7013 (2001).
He, "Procedure for preparing peptide-major histocompatibility complex tetramers for direct quantification of antigen-specific cytotoxic T lymphocytes," World J Gastroenterol, vol. 11, No. 27, pp. 4180-4187 (2005).
Ochoa-Garay et al. (Mol. Immunol., 1997, 34(3): 273-281).
Kao, "Loss of CD8 and TCR binding to Class I MHC ligands following T cell activation," International Immunology, vol. 17, No. 12, pp. 1607-1617 (2005).
Karin, "Reversal of Experimental Autoimmune Encephalomyelitis by a Soluble Peptide Variant of a Myelin Basic Protein Epitope: T Cell Receptor Antagonism and Reduction of Interferon γ and Tumor Necrosis Factor α Production," J. Exp. Med., vol. 180, pp. 2227-2237 (1994).
Kronenberg, "The Unconventional Lifestyle of NKT Cells," Nature Reviews Immunology, vol. 2, pp. 557-568 (2002).
Nepom, "MHC Multimers: expanding the clinical toolkit," Clinical Immunology, vol. 106, pp. 1-4 (2003).
Parker, "Peptide Binding to HLA-A2 and HLA-B27 Isolated from *Escherichia coli*," The Journal of Biological Chemistry, vol. 267, pp. 5451-5459 (1992).
Rognan, "Rational design of nonnatural peptides as high-affinity ligands for the HLA-B*2705 human leukocyte antigen," Proc. Natl. Acad. Sci. USA, vol. 92, pp. 753-757 (1995).
Ruan, "Preparation of HLA-A*0201 NLVPMVATV peptide tetramers and application to detect cytomegalovirus specific CTL," Zhonghua Weishengwuxue He Mianyixue Zazhi, vol. 26., No. 9, pp. 855-858 (2006)—English Abstract Only.
Ruan, "Improved preparation of class I HLA tetramers and their use in detecting CMV-specific CTL," Journal of Immunological Methods, vol. 312, pp. 148-156 (2006).
Schueler-Furman, "Structure-based prediction of binding peptides to MHC class I molecules: Application to a broad range of MHC alleles," Protein Science, vol. 9, pp. 1838-1846 (2000).
Theisen, "Evolution of the borrelia burgdorferi outer surface protein OspC," Journal of Bacteriology vol. 177, No. 11, pp. 3036-3044 (1995).
Weinberg, "The Biology of Cancer," Garland Science, pp. 737-747 (2007).
Wulff, "Guide to Flow Cytometry," Dako Educational Guide, www.dako.com, (2006).
Lundegaard et al. (Bioinformatics, Apr. 14, 2008,24(11): 1397-1398) (Year: 2008).
Song et al. (Cell. Mol. Immunol., 2013, 10: 40-496) (Year: 2013).
Dibrino et al. (J. Immnology 151(11) 5390-5935, 1993).
Celis et al. (Molecular Immuno. 3: 1423-1430, 1994).
Denkberg et al. (Eur. J. Immunol., 2000, 30: 3522-3532.
Schatz, Peter J., "Use of Peptide Libraries to Map the Substrate Specificity of a Peptide-Modifying Enzyme: A 13 Residue Consensus Peptide Specifies Biotinylation in *Escherichia coli*", 1993 Nature Publishing Group, Biotchnology vol. 11, pp. 1138-1143.
Garboczi et al., "Structure of the complex between human T-cell receptor, viral peptide and HLA-A2", Nature, vol. 384, Nov. 14, 1996, pp. 134-141.
"A Database of MHC Ligands and Peptide Motifs" Available at: syfpeithi.de/ and bio.tools/hla_bind and services.healthtech.dtu.dk/service.php?NetMHC-4.0 and services.healthtech.dtu.dk/service.php?NetMHCII-2.3.
Signorino et al., "Identification of OppA2 Linear Epitopes as Serodiagnostic Markers for Lyme Disease", Clinical and Vaccine Immunology, vol. 21, No. 5, Mar. 12, 2014 (Mar. 12, 2014), pp. 704-711.
U.S. Appl. No. 12/919,405, filed Jan. 20, 2011, Brix, Liselotte et al.

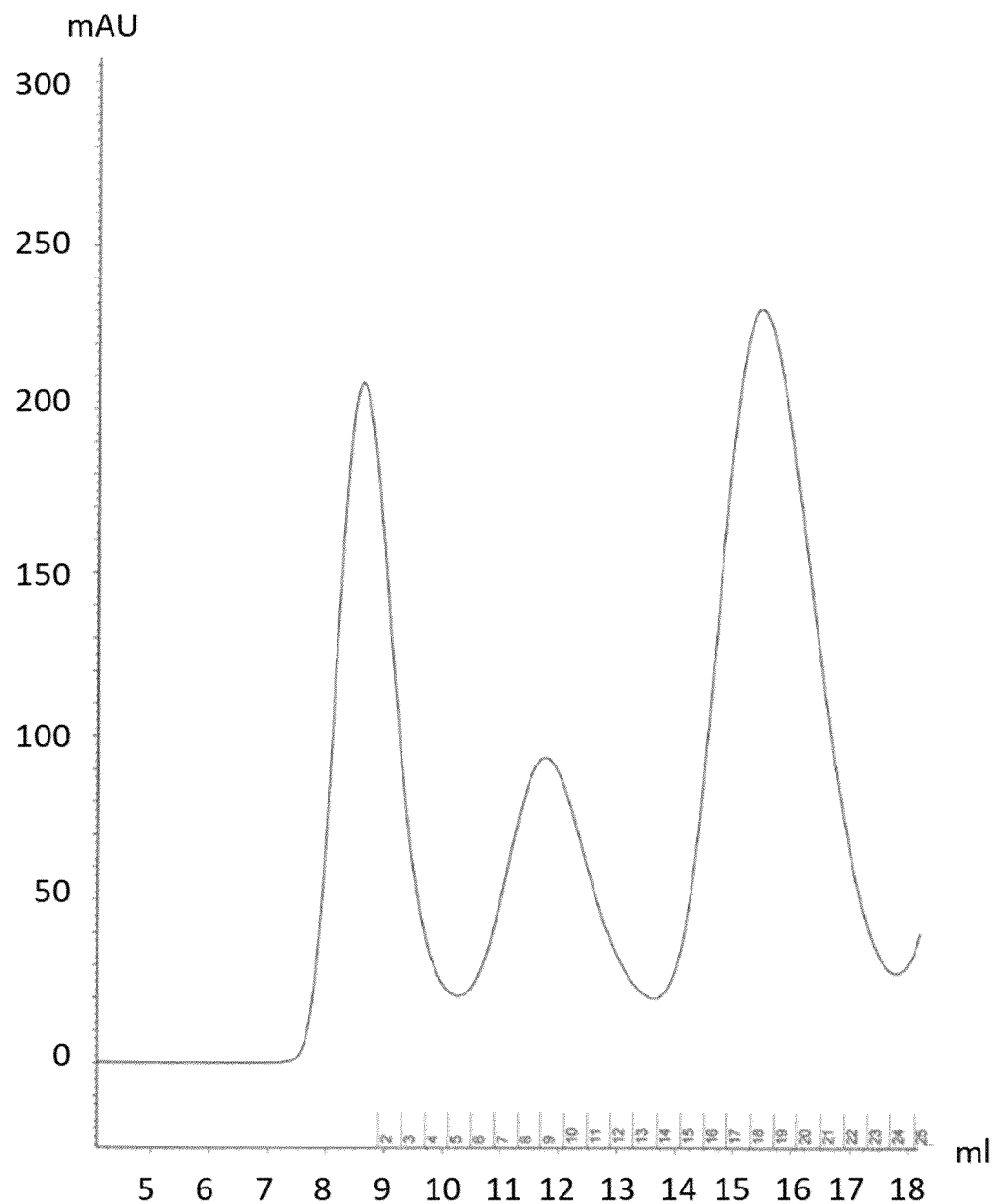
Fig 1A. Size exclusion chromatography of folded HLA-A*0201-β2m-YLNTKSNGNYEI (SEQ ID NO:359)-complex.

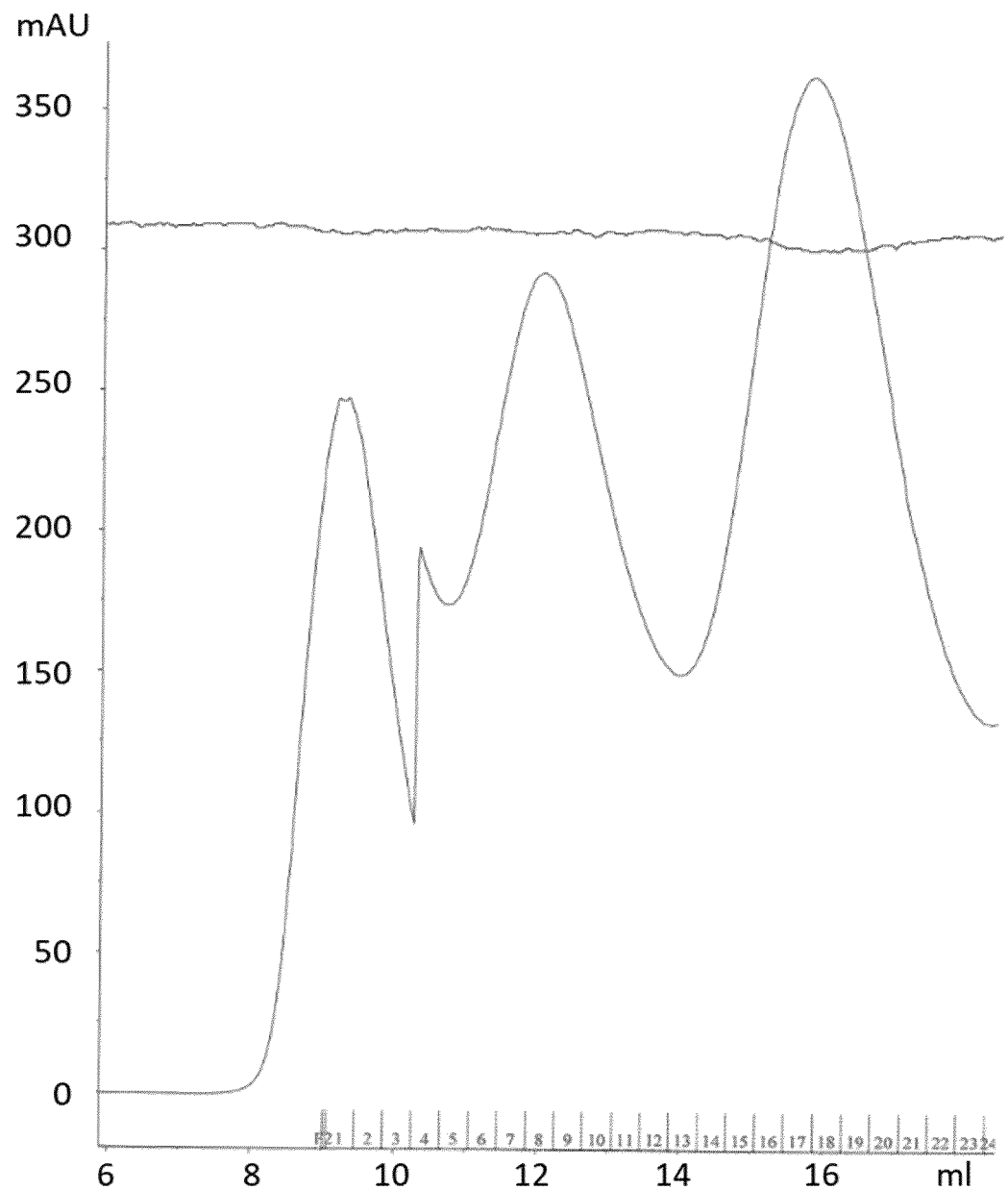
Fig 1B. Size exclusion chromatography of folded HLA-A*0201-β2m-FLSIFTQGYT (SEQ ID NO:241)-complex.

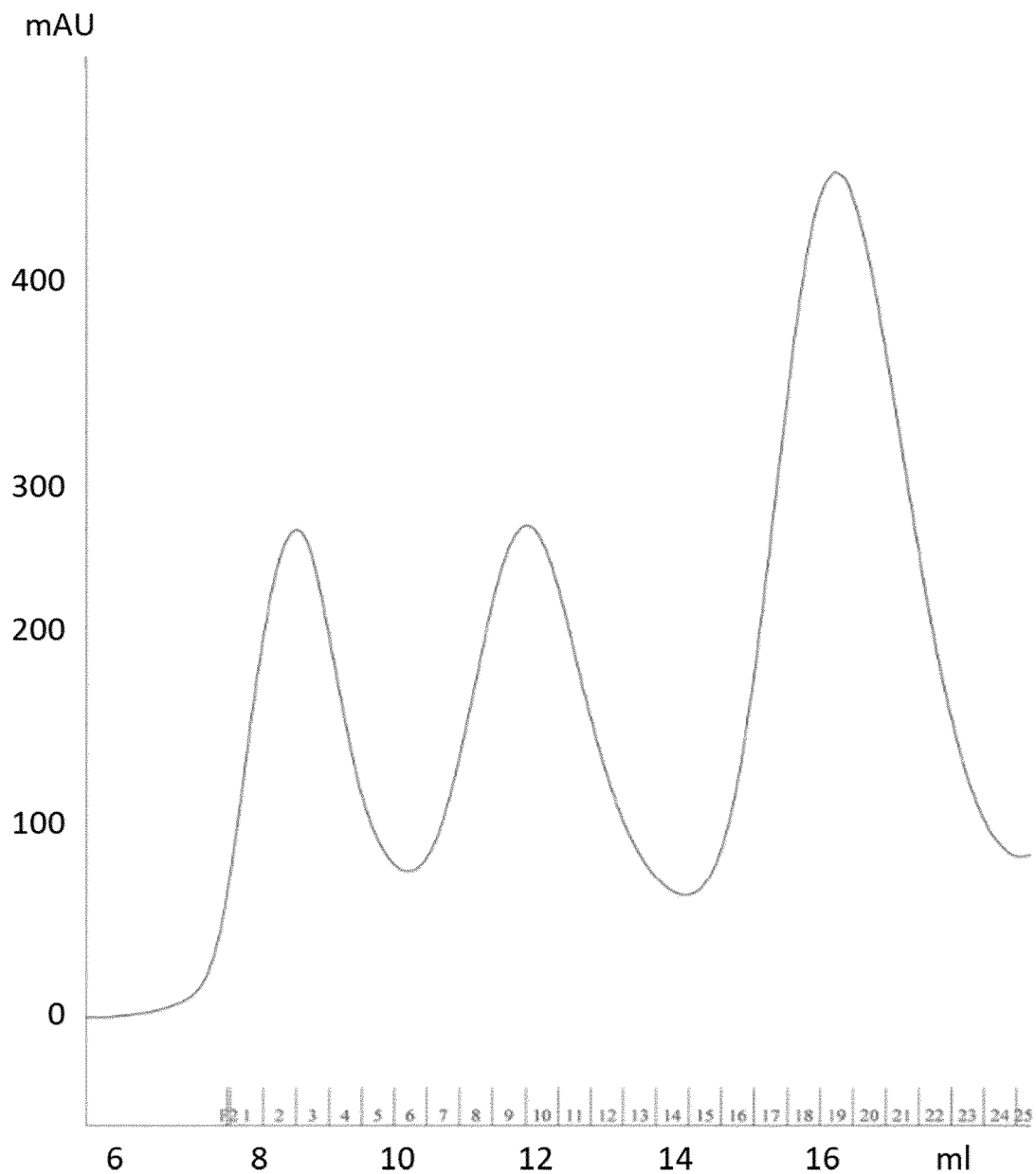
Fig 1C. Size exclusion chromatography of folded HLA-A*0201-β2m-GIYDLILNA (SEQ ID NO: 2761)-complex.

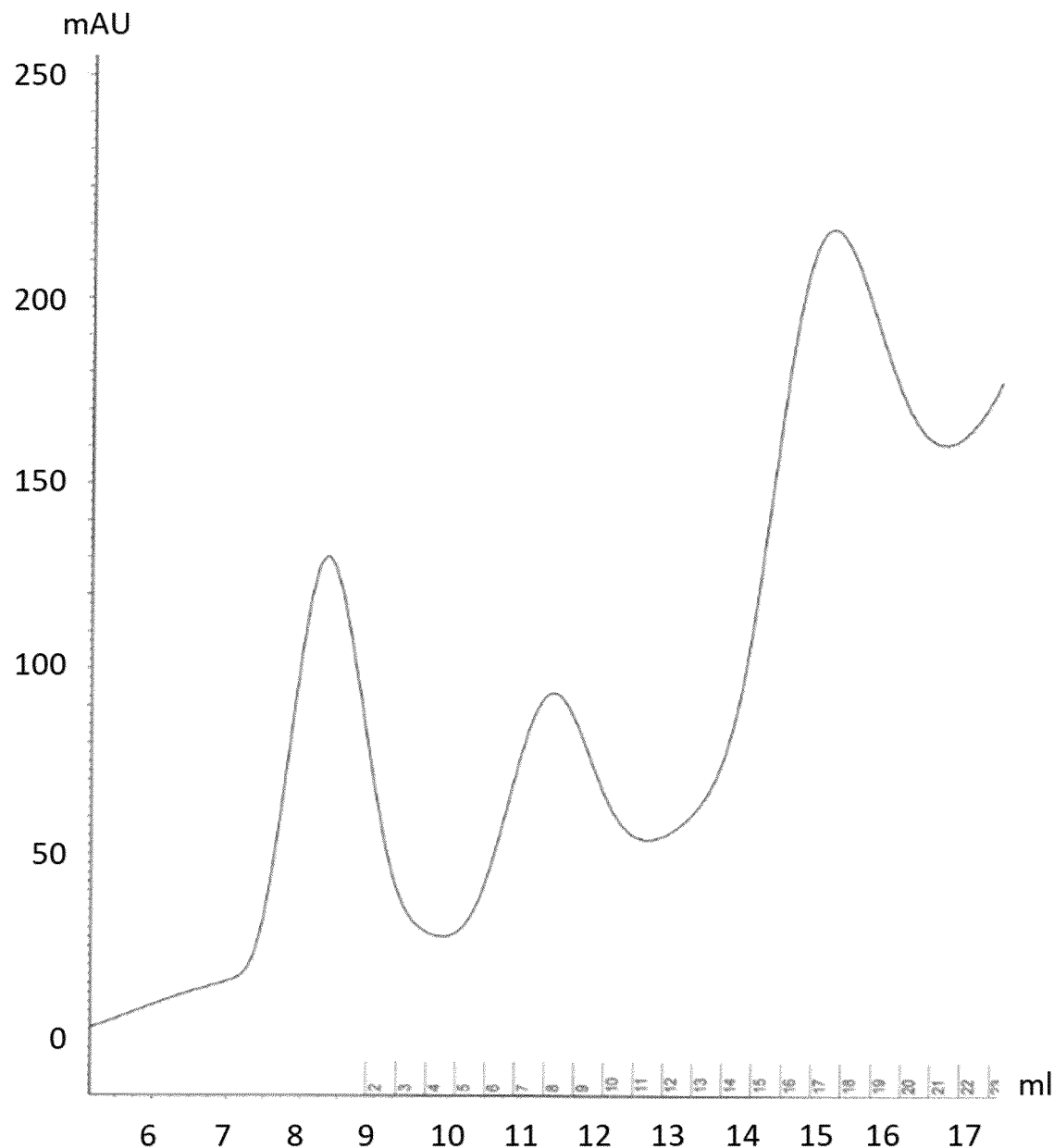
Fig 1D. Size exclusion chromatography of folded HLA-A*0201-β2m-YIKDINEFI (SEQ ID NO: 4479)-complex.

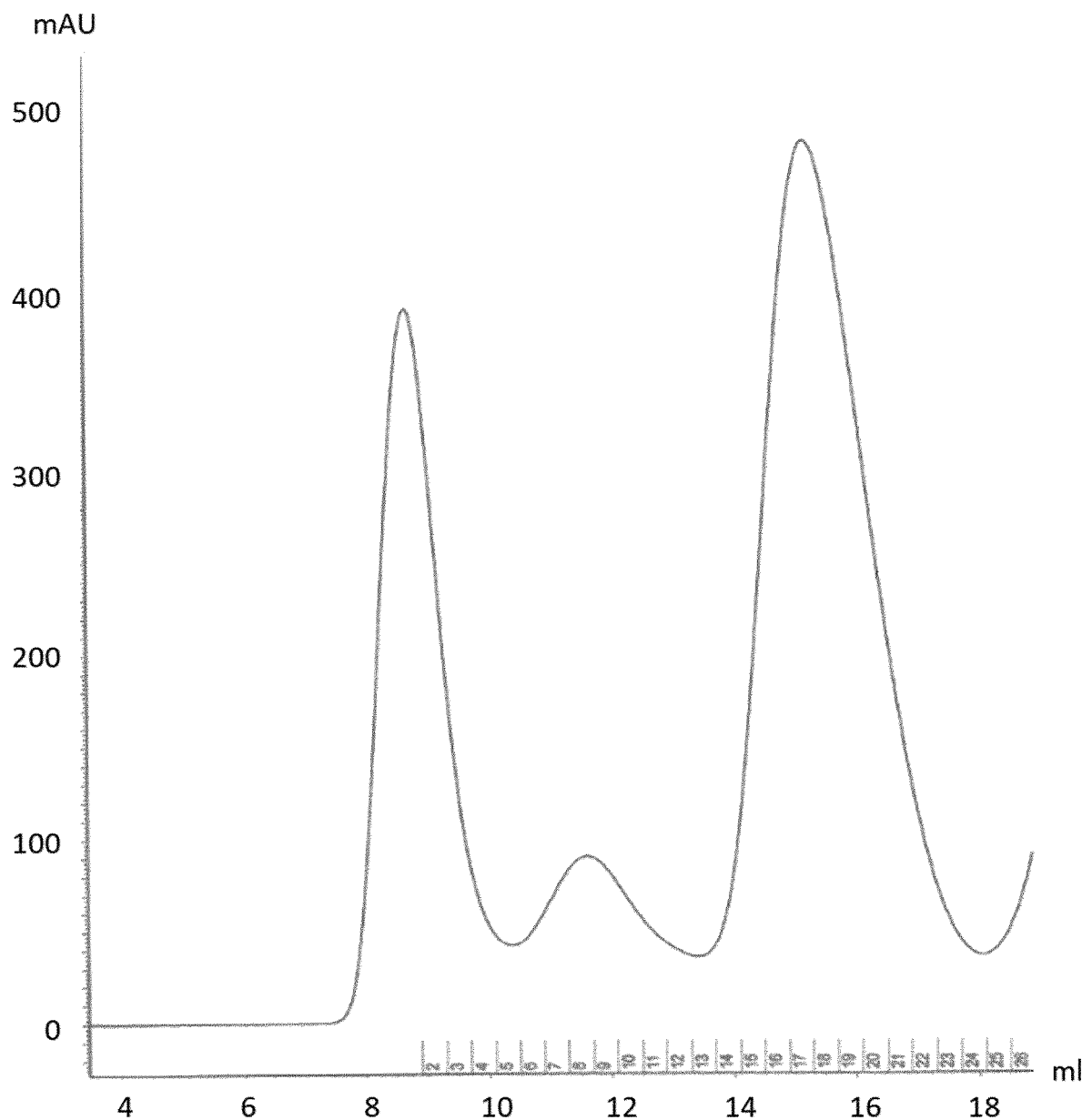
Fig 1E. Size exclusion chromatography of folded HLA-A*0201-β2m-IQIEIEQLTDEI (SEQ ID NO:5126)-complex.

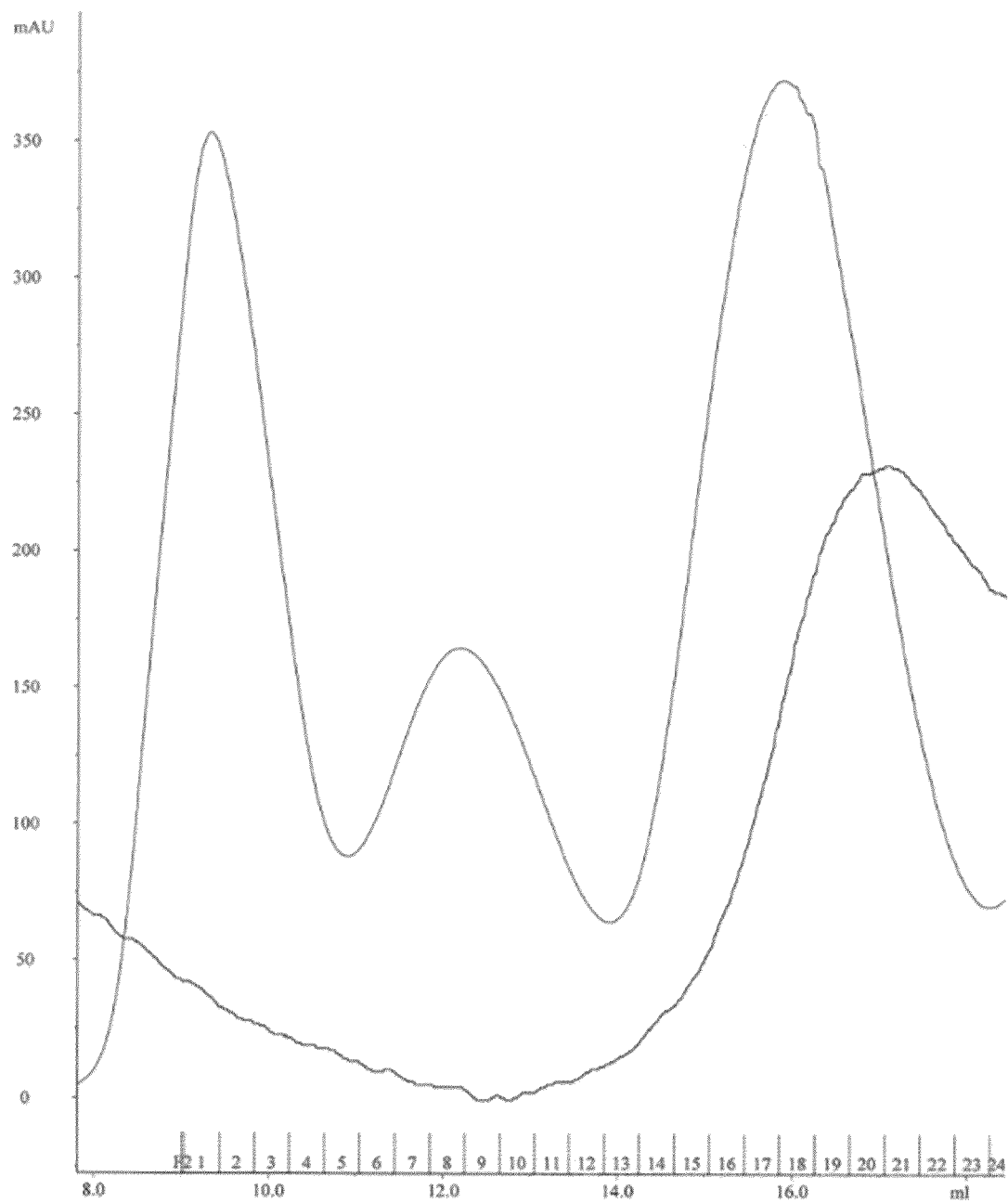
Fig 1F. Size exclusion chromatography of folded HLA-A*0201-β2m-RMISDQRANLGA (SEQ ID NO: 5127)-complex

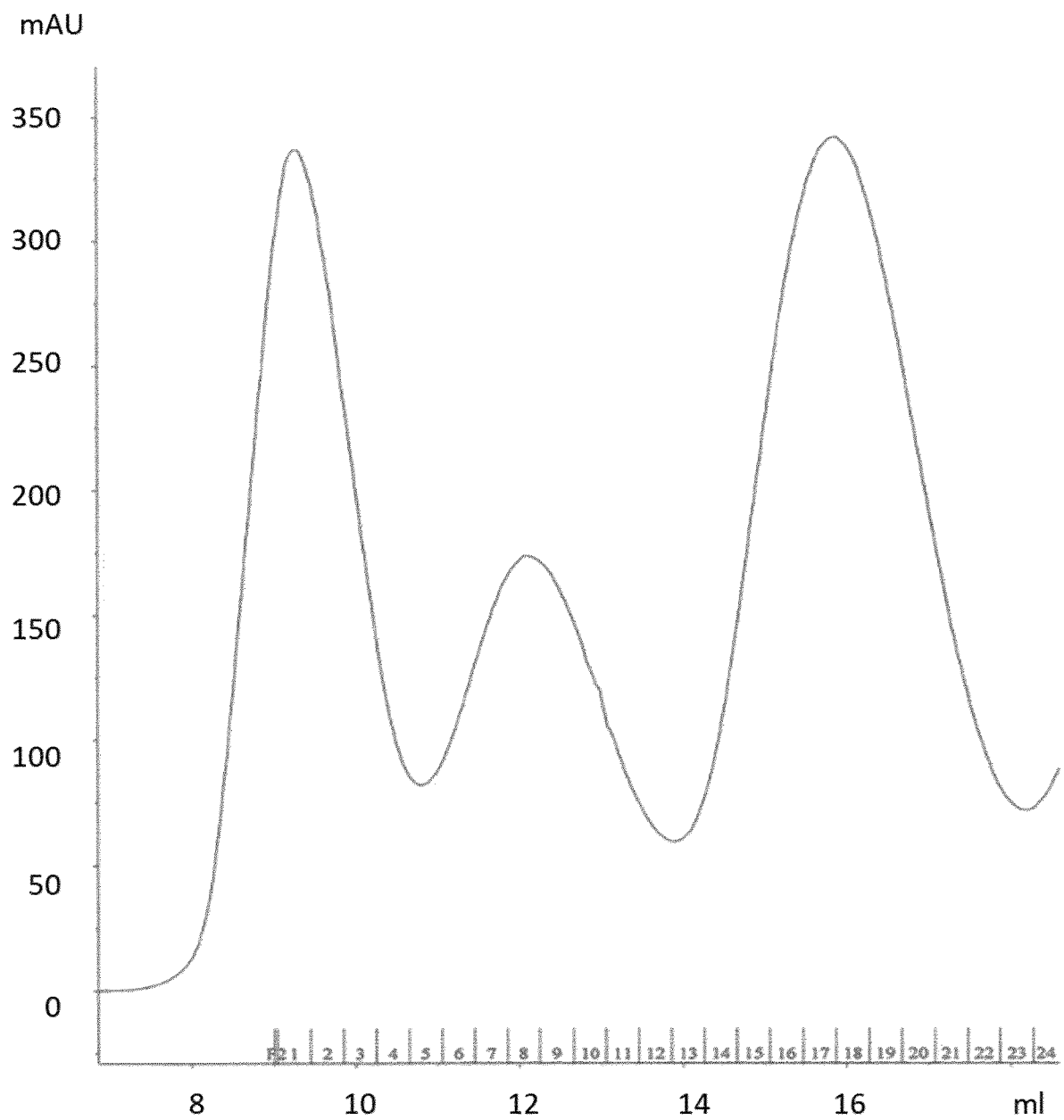
Fig 1G. Size exclusion chromatography of folded HLA-A*0201-β2m-SQGGVNSPV (SEQ ID NO: 5344)-complex.

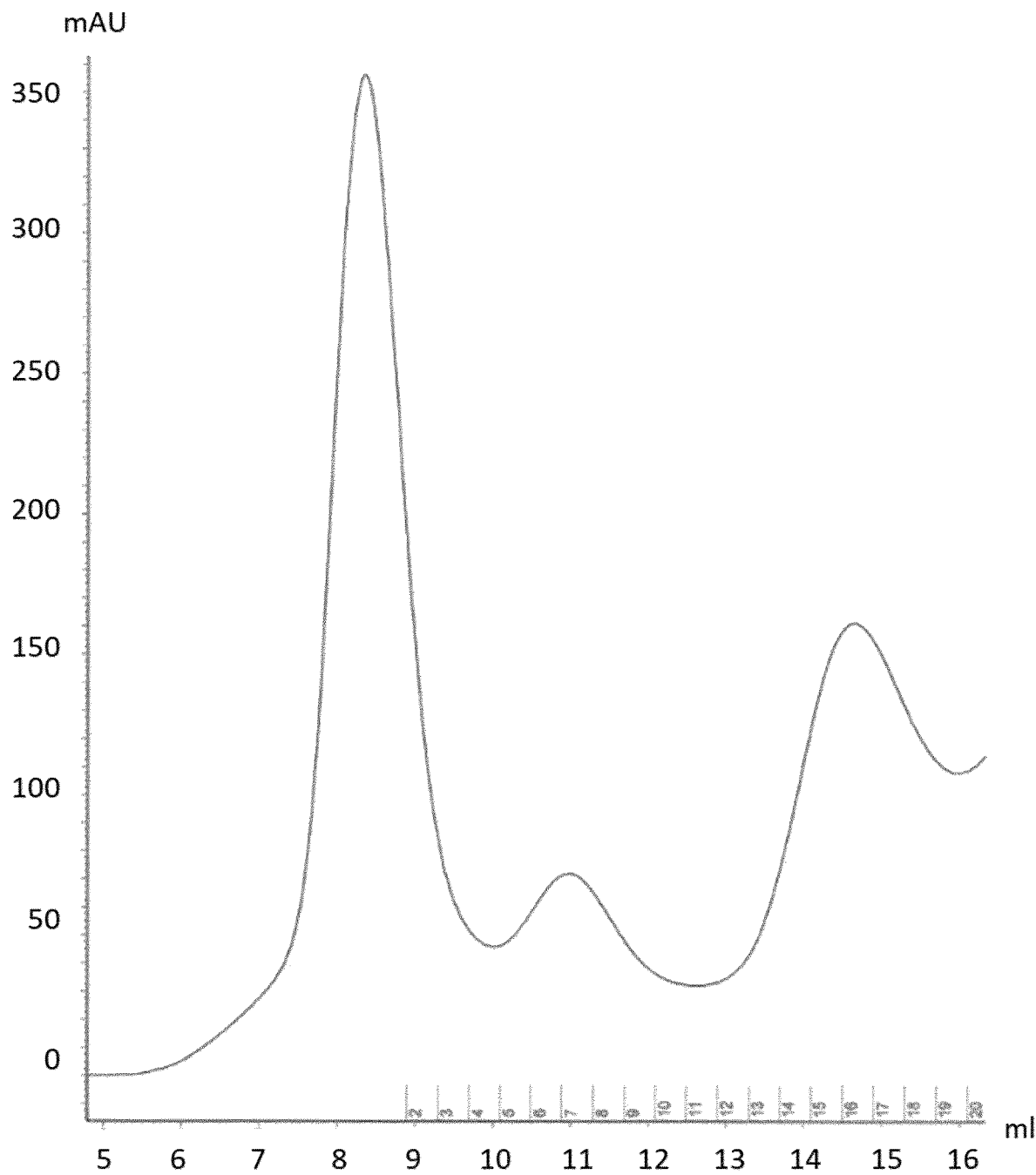
Fig 1H. Size exclusion chromatography of folded HLA-A*0201-β2m-MLDEAKDKL(SEQ ID NO: 5516) -complex.

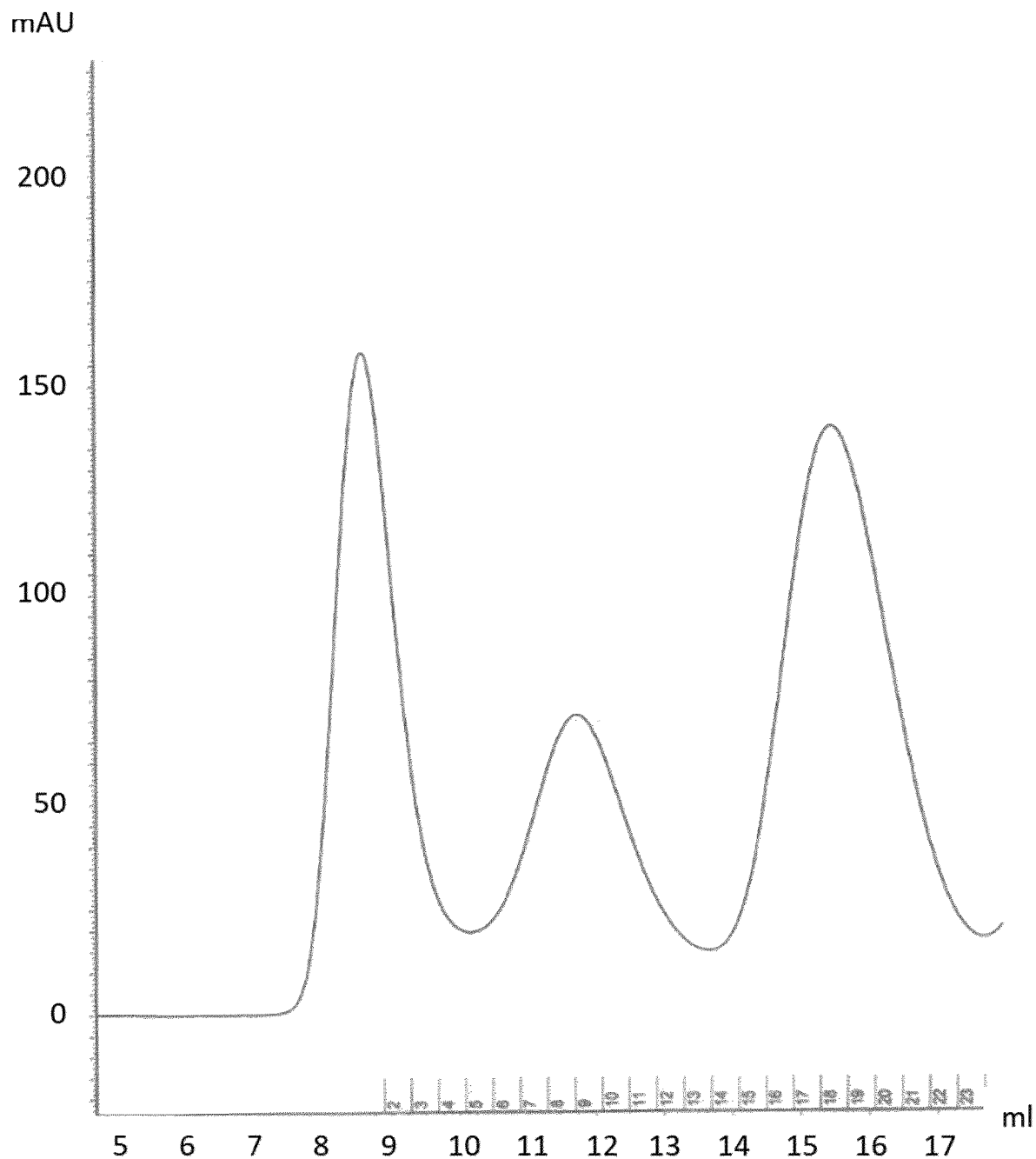
Fig 1I. Size exclusion chromatography of folded HLA-A*0201-β2m-FMEQATNSWI (SEQ ID NO:5530)-complex.

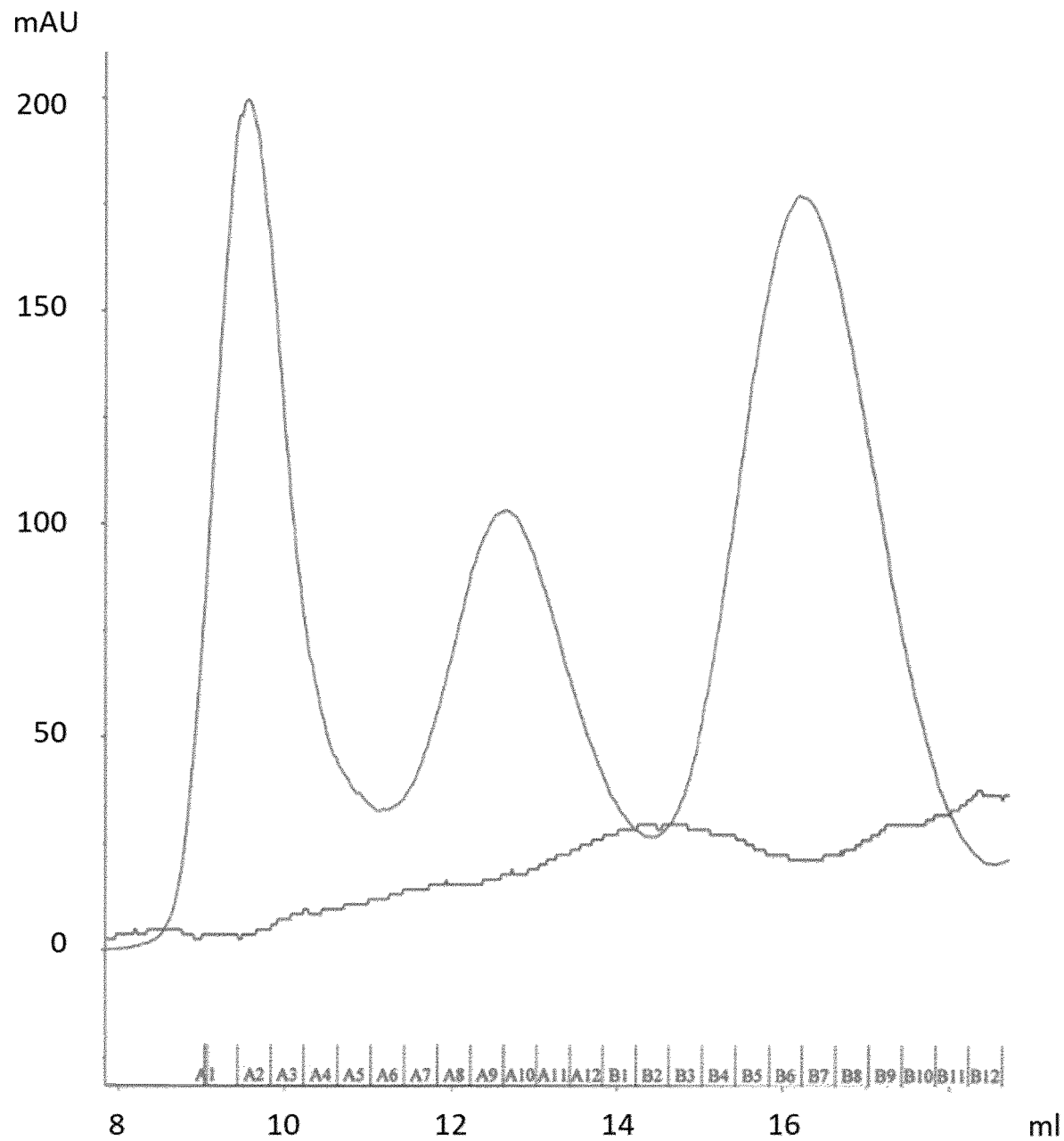
Fig 1J. Size exclusion chromatography of folded HLA-A*0201-β2m-NLVFSSLFL (SEQ ID NO:5510)-complex.

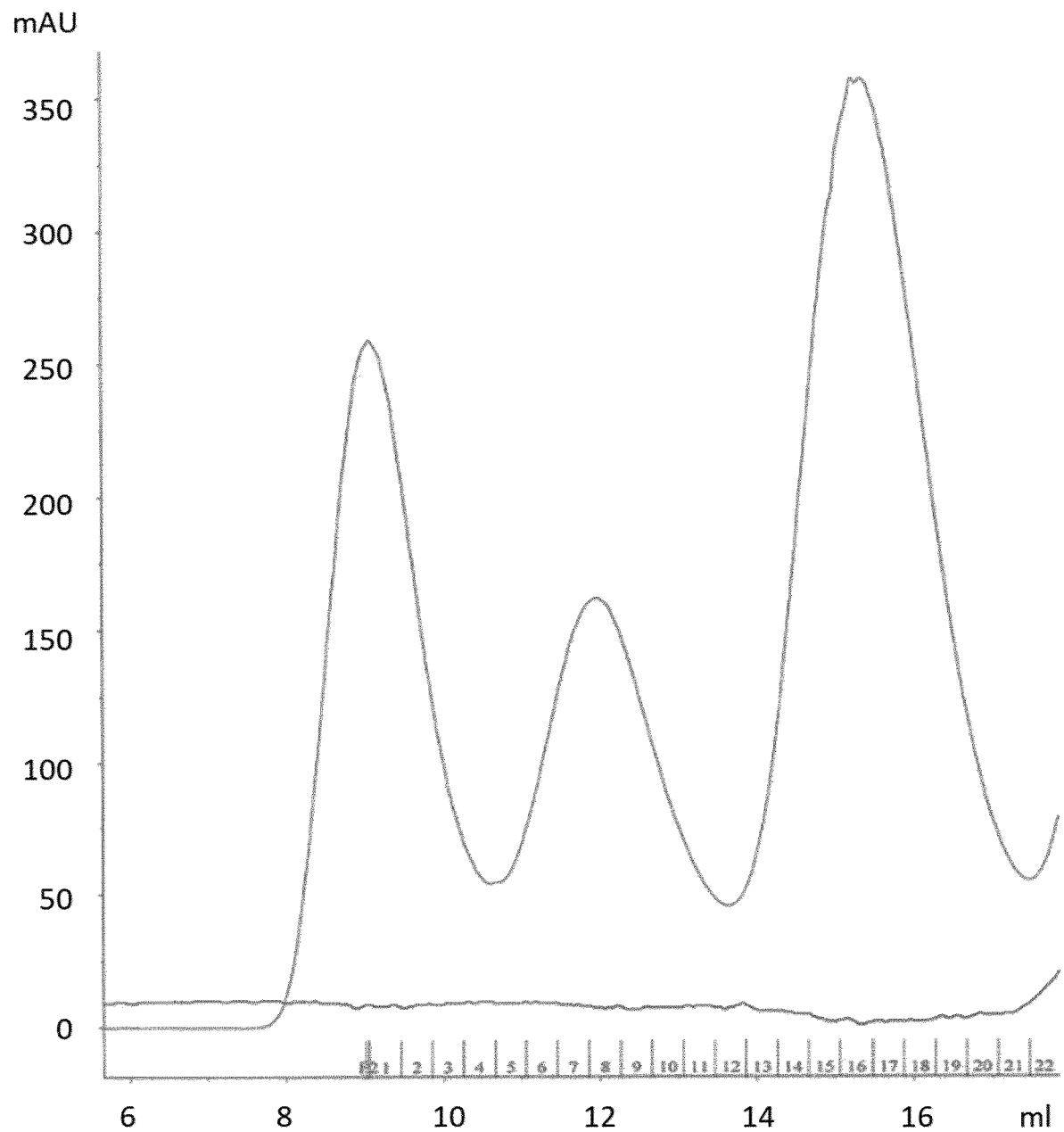
Fig 1K. Size exclusion chromatography of folded HLA-A*0201-β2m-KLAESIYKRL (SEQ ID NO: 5531)-complex.

| Lane | Samlpe | Lot | Tung Kæde | Peptid | Foldet MHC/µg | Streptavidin/µg | Control | Lane |
|---|---|---|---|---|---|---|---|---|
| | | | | | | | Streptavidin | 26 |
| | | | | | | | Markør | 1 |
| 2 | 1A | 20180115-HB8 | A*0201 | VPLYDLLLEM | 1 | 1,8 | | |
| 3 | 1B | 20180115-HB8 | A*0201 | VPLYDLLLEM | 0,1 | 0 | | |
| 4 | 1C | 20180115-HB8 | A*0201 | VPLYDLLLEM | 0,25 | 0 | | |
| 5 | 1D | 20180115-HB8 | A*0201 | VPLYDLLLEM | 1 | 0 | | |
| 6 | 2A | 20180122-HB1 | A*0201 | IQIEIEQLTDEI | 1 | 1,8 | | |
| 7 | 2B | 20180122-HB1 | A*0201 | IQIEIEQLTDEI | 0,1 | 0 | | |
| 8 | 2C | 20180122-HB1 | A*0201 | IQIEIEQLTDEI | 0,25 | 0 | | |
| 9 | 2D | 20180122-HB1 | A*0201 | IQIEIEQLTDEI | 1 | 0 | | |
| 10 | 3A | 20180122-HB2 | A*0201 | VLHDDLLEA | 1 | 1,8 | | |
| 11 | 3B | 20180122-HB2 | A*0201 | VLHDDLLEA | 0,1 | 0 | | |
| 12 | 3C | 20180122-HB2 | A*0201 | VLHDDLLEA | 0,25 | 0 | | |
| 13 | 3D | 20180122-HB2 | A*0201 | VLHDDLLEA | 1 | 0 | | |
| 14 | 4A | 20180122-HB3 | A*0201 | YLNTKSNGNYEI | 1 | 1,8 | | |
| 15 | 4B | 20180122-HB3 | A*0201 | YLNTKSNGNYEI | 0,1 | 0 | | |
| 16 | 4C | 20180122-HB3 | A*0201 | YLNTKSNGNYEI | 0,25 | 0 | | |
| 17 | 4D | 20180122-HB3 | A*0201 | YLNTKSNGNYEI | 1 | 0 | | |
| 18 | 5A | 20180122-HB4 | A*0201 | NMLSTVLGV | 1 | 1,8 | | |
| 19 | 5B | 20180122-HB4 | A*0201 | NMLSTVLGV | 0,1 | 0 | | |
| 20 | 5C | 20180122-HB4 | A*0201 | NMLSTVLGV | 0,25 | 0 | | |
| 21 | 5D | 20180122-HB4 | A*0201 | NMLSTVLGV | 1 | 0 | | |
| 22 | 6A | 20180122-HB5 | A*0201 | ALDQTDIRV | 1 | 1,8 | | |
| 23 | 6B | 20180122-HB5 | A*0201 | ALDQTDIRV | 0,1 | 0 | | |
| 24 | 6C | 20180122-HB5 | A*0201 | ALDQTDIRV | 0,25 | 0 | | |
| 25 | 6D | 20180122-HB5 | A*0201 | ALDQTDIRV | 1 | 0 | | |

Fig. 2A. YLNTKSNGNYEI (SEQ ID NO:359)-SHIFT Assay

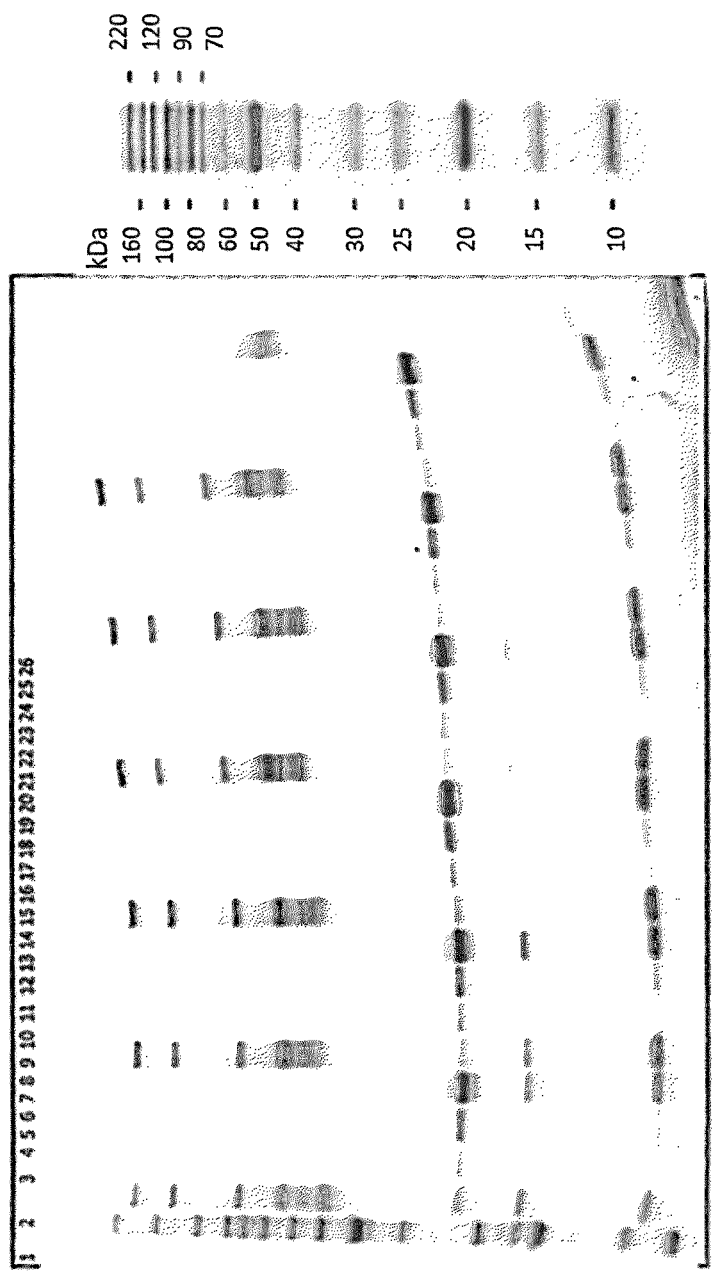
Fig. 2A-1. YLNTKSNGNYEI (SEQ ID NO:359)-SHIFT Assay

| Lane | Sample | Lot | Tung kæde | poptid | Foldet MHC / µg | Streptavidin / µg | Control | Lane |
|---|---|---|---|---|---|---|---|---|
| | | | | | | | Streptavidin Markør | 26 |
| | | | | | | | | 1 |
| 2 | 1A | 20170328-HB1 | A0201 | YLNTKSNGNYEI | 1 | 1,8 | | |
| 3 | 1B | 20170328-HB1 | A0201 | YLNTKSNGNYEI | 0,1 | 0 | | |
| 4 | 1C | 20170328-HB1 | A0201 | YLNTKSNGNYEI | 0,25 | 0 | | |
| 5 | 1D | 20170328-HB1 | A0201 | YLNTKSNGNYEI | 1 | 0 | | |
| 6 | 2A | 20170328-HB2 | A0201 | MLVHQFIPIPI | 1 | 1,8 | | |
| 7 | 2B | 20170328-HB2 | A0201 | MLVHQFIPIPI | 0,1 | 0 | | |
| 8 | 2C | 20170328-HB2 | A0201 | MLVHQFIPIPI | 0,25 | 0 | | |
| 9 | 2D | 20170328-HB2 | A0201 | MLVHQFIPIPI | 1 | 0 | | |
| 10 | 3A | 20170328-HB3 | A0201 | FLSIFTQGYT | 1 | 1,8 | | |
| 11 | 3B | 20170328-HB3 | A0201 | FLSIFTQGYT | 0,1 | 0 | | |
| 12 | 3C | 20170328-HB3 | A0201 | FLSIFTQGYT | 0,25 | 0 | | |
| 13 | 3D | 20170328-HB3 | A0201 | FLSIFTQGYT | 1 | 0 | | |
| 14 | 4A | 20170328-HB4 | A0201 | IQIEIEQLTDEI | 1 | 1,8 | | |
| 15 | 4B | 20170328-HB4 | A0201 | IQIEIEQLTDEI | 0,1 | 0 | | |
| 16 | 4C | 20170328-HB4 | A0201 | IQIEIEQLTDEI | 0,25 | 0 | | |
| 17 | 4D | 20170328-HB4 | A0201 | IQIEIEQLTDEI | 1 | 0 | | |
| 18 | 5A | 250170328-KB1 | A0201 | NLVPMVATV | 1 | 1,8 | | |
| 19 | 5B | 250170328-KB1 | A0201 | NLVPMVATV | 0,1 | 0 | | |
| 20 | 5C | 250170328-KB1 | A0201 | NLVPMVATV | 0,25 | 0 | | |
| 21 | 5D | 250170328-KB1 | A0201 | NLVPMVATV | 1 | 0 | | |
| 22 | 6A | 250170328-KB2 | A0201 | ALIAPVHAV | 1 | 1,8 | | |
| 23 | 6B | 250170328-KB2 | A0201 | ALIAPVHAV | 0,1 | 0 | | |
| 24 | 6C | 250170328-KB2 | A0201 | ALIAPVHAV | 0,25 | 0 | | |
| 25 | 6D | 250170328-KB2 | A0201 | ALIAPVHAV | 1 | 0 | | |

Fig. 2B. FLSIFTQGYT (SEQ ID NO:241)-SHIFT Assay

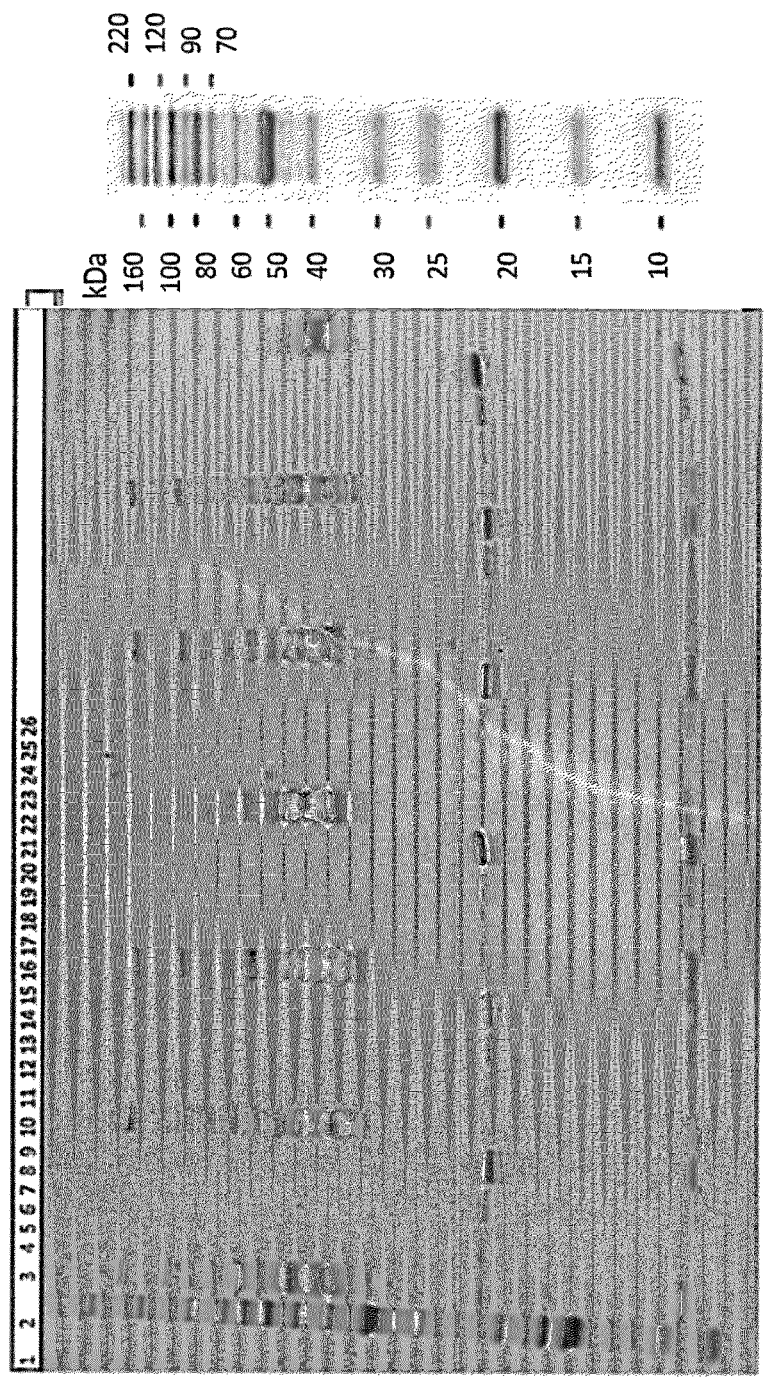
Fig. 2B-1. FLSIFTQGYT (SEQ ID NO:241)-SHIFT Assay

| Lane | Samlpe | Lot | Tung Kæde | Peptid | Foldet MHC/µg | Streptavidin/µg | Control Lane | |
|---|---|---|---|---|---|---|---|---|
| | | | | | | | Streptavidin | 17 |
| | | | | | | | Marker | 18 |
| 1A | 20151117-LL1 | H-2 Kb | VSLTYVSF | 1 | 1,8 | | |
| 1B | 20151117-LL1 | H-2 Kb | VSLTYVSF | 0,1 | 0 | | |
| 1C | 20151117-LL1 | H-2 Kb | VSLTYVSF | 0,25 | 0 | | |
| 1D | 20151117-LL1 | H-2 Kb | VSLTYVSF | 1 | 0 | | |
| 2A | 20151117-LL2 | H-2 Db | CVNRNLTEV | 1 | 1,8 | | |
| 2B | 20151117-LL2 | H-2 Db | CVNRNLTEV | 0,1 | 0 | | |
| 2C | 20151117-LL2 | H-2 Db | CVNRNLTEV | 0,25 | 0 | | |
| 2D | 20151117-LL2 | H-2 Db | CVNRNLTEV | 1 | 0 | | |
| 3A | 20151117-LL3 | H-2 Db | NSLVSLTYV | 1 | 1,8 | | |
| 3B | 20151117-LL3 | H-2 Db | NSLVSLTYV | 0,1 | 0 | | |
| 3C | 20151117-LL3 | H-2 Db | NSLVSLTYV | 0,25 | 0 | | |
| 3D | 20151117-LL3 | H-2 Db | NSLVSLTYV | 1 | 0 | | |
| 4A | 20151117-LL4 | A*0201 | GIYDLILNA | 1 | 1,8 | | |
| 4B | 20151117-LL4 | A*0201 | GIYDLILNA | 0,1 | 0 | | |
| 4C | 20151117-LL4 | A*0201 | GIYDLILNA | 0,25 | 0 | | |
| 4D | 20151117-LL4 | A*0201 | GIYDLILNA | 1 | 0 | | |
| 5A | 20151116-KB5 | A*2402 | FYQSLPPRLEW | 1 | 1,8 | | |
| 5B | 20151116-KB5 | A*2402 | FYQSLPPRLEW | 0,1 | 0 | | |
| 5C | 20151116-KB5 | A*2402 | FYQSLPPRLEW | 0,25 | 0 | | |
| 5D | 20151116-KB5 | A*2402 | FYQSLPPRLEW | 1 | 0 | | |
| 6A | 20151116-KB11 | A*2402 | IFAGGYLAF | 1 | 1,8 | | |
| 6B | 20151116-KB11 | A*2402 | IFAGGYLAF | 0,1 | 0 | | |
| 6C | 20151116-KB11 | A*2402 | IFAGGYLAF | 0,25 | 0 | | |
| 6D | 20151116-KB11 | A*2402 | IFAGGYLAF | 1 | 0 | | |

Fig. 2C. GIYDLILNA (SEQ ID NO:2761)-SHIFT Assay

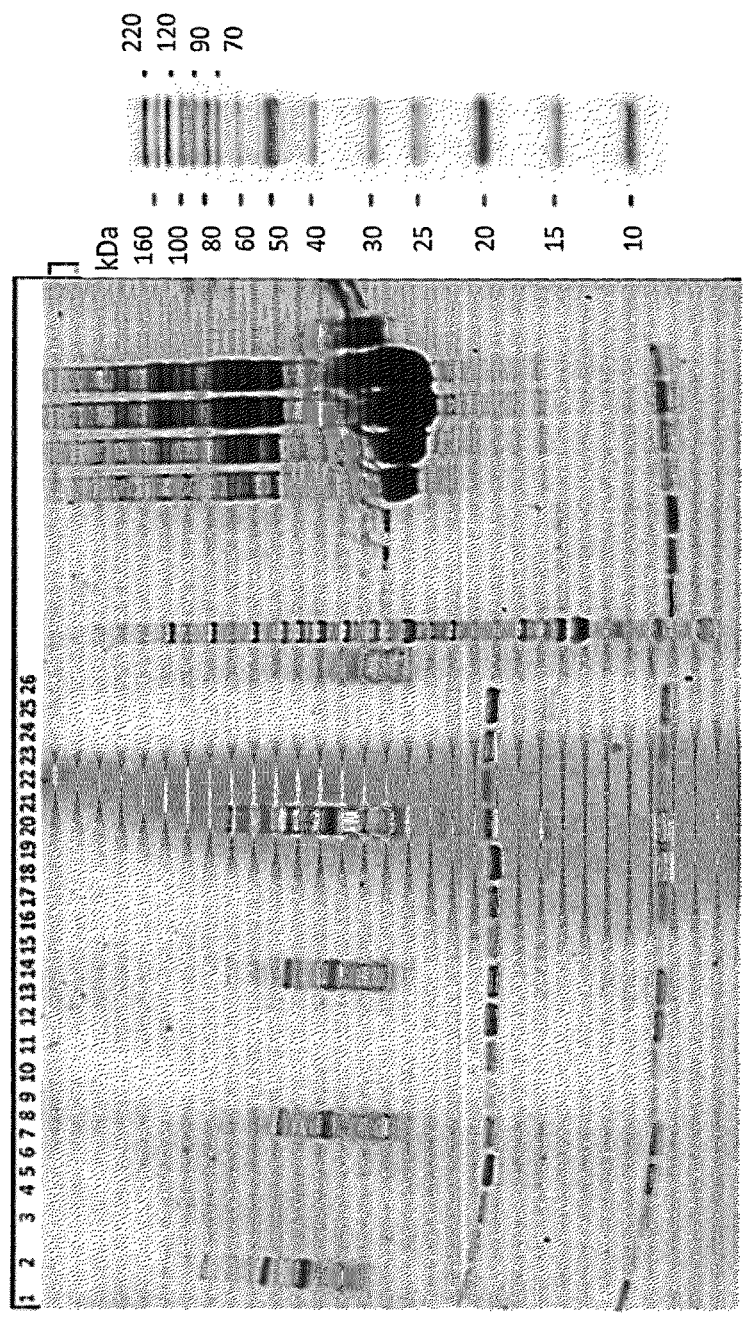
Fig. 2C-1. GIYDLILNA (SEQ ID NO:2761)-SHIFT Assay

| Lane | Samlpe | Lot | Tung Kæde | Peptid | Foldet MHC/μg | Streptavidin/μg | Control Lane | |
|---|---|---|---|---|---|---|---|---|
| 2 | 1A | 20180123-HB5 | A*0201 | FMEQATNSWI | 1 | 1,8 | Streptavidin Marker | 26 |
| 3 | 1B | 20180123-HB5 | A*0201 | FMEQATNSWI | 0,1 | 0 | | 1 |
| 4 | 1C | 20180123-HB5 | A*0201 | FMEQATNSWI | 0,25 | 0 | | |
| 5 | 1D | 20180123-HB5 | A*0201 | FMEQATNSWI | 1 | 0 | | |
| 6 | 2A | 20180123-HB6 | A*0201 | YIKDINEFI | 1 | 1,8 | | |
| 7 | 2B | 20180123-HB6 | A*0201 | YIKDINEFI | 0,1 | 0 | | |
| 8 | 2C | 20180123-HB6 | A*0201 | YIKDINEFI | 0,25 | 0 | | |
| 9 | 2D | 20180123-HB6 | A*0201 | YIKDINEFI | 1 | 0 | | |
| 10 | 3A | 20180129-HB1 | A*0201 | NLVPMVATV | 1 | 1,8 | | |
| 11 | 3B | 20180129-HB1 | A*0201 | NLVPMVATV | 0,1 | 0 | | |
| 12 | 3C | 20180129-HB1 | A*0201 | NLVPMVATV | 0,25 | 0 | | |
| 13 | 3D | 20180129-HB1 | A*0201 | NLVPMVATV | 1 | 0 | | |
| 14 | 4A | 20180129-HB2 | A*0201 | NLVPMVATV | 1 | 1,8 | | |
| 15 | 4B | 20180129-HB2 | A*0201 | NLVPMVATV | 0,1 | 0 | | |
| 16 | 4C | 20180129-HB2 | A*0201 | NLVPMVATV | 0,25 | 0 | | |
| 17 | 4D | 20180129-HB2 | A*0201 | NLVPMVATV | 1 | 0 | | |
| 18 | 5A | 20180129-HB3 | A*0201 | ALDQTDIRV | 1 | 1,8 | | |
| 19 | 5B | 20180129-HB3 | A*0201 | ALDQTDIRV | 0,1 | 0 | | |
| 20 | 5C | 20180129-HB3 | A*0201 | ALDQTDIRV | 0,25 | 0 | | |
| 21 | 5D | 20180129-HB3 | A*0201 | ALDQTDIRV | 1 | 0 | | |
| 22 | 6A | 20180129-HB4 | A*0201 | YLYHRVDVI | 1 | 1,8 | | |
| 23 | 6B | 20180129-HB4 | A*0201 | YLYHRVDVI | 0,1 | 0 | | |
| 24 | 6C | 20180129-HB4 | A*0201 | YLYHRVDVI | 0,25 | 0 | | |
| 25 | 6D | 20180129-HB4 | A*0201 | YLYHRVDVI | 1 | 0 | | |

Fig. 2D. YIKDINEFI (SEQ ID NO:4479-SHIFT Assay

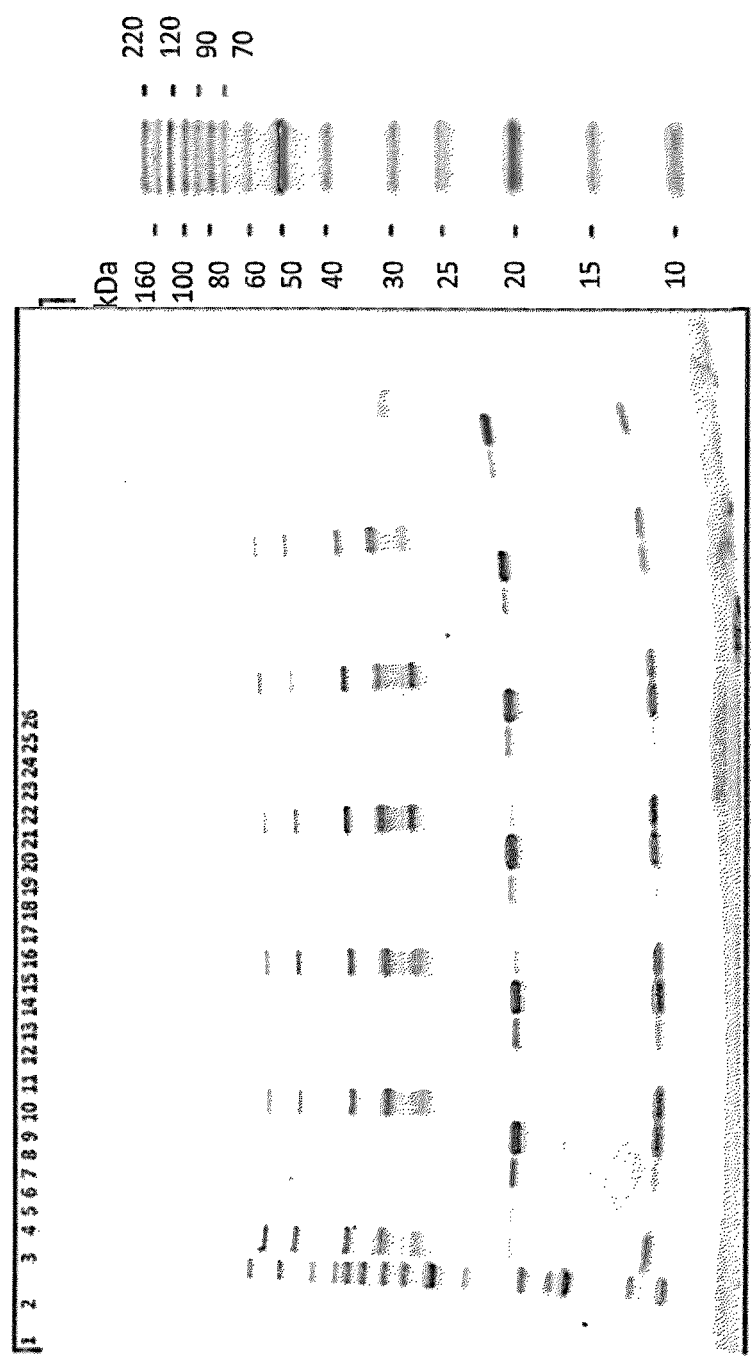
Fig. 2D-1. YIKDINEFI (SEQ ID NO:4479-SHIFT Assay

| Lane | Samlpe | Lot | Tung Kæde | Peptid | Foldet MHC/µg | Streptavidin/µg | Control Lane |
|---|---|---|---|---|---|---|---|
| | | | | | | Streptavidin | 26 |
| | | | | | | Marker | 1 |
| 2 | 1A | 20180115-HB8 | A*0201 | VPLYDLLLEM | | 1,8 | |
| 3 | 1B | 20180115-HB8 | A*0201 | VPLYDLLLEM | 0,1 | 0 | |
| 4 | 1C | 20180115-HB8 | A*0201 | VPLYDLLLEM | 0,25 | 0 | |
| 5 | 1D | 20180115-HB8 | A*0201 | VPLYDLLLEM | 1 | 0 | |
| 6 | 2A | 20180122-HB1 | A*0201 | IQIEIEQLTDEI | | 1,8 | |
| 7 | 2B | 20180122-HB1 | A*0201 | IQIEIEQLTDEI | 0,1 | 0 | |
| 8 | 2C | 20180122-HB1 | A*0201 | IQIEIEQLTDEI | 0,25 | 0 | |
| 9 | 2D | 20180122-HB1 | A*0201 | IQIEIEQLTDEI | 1 | 0 | |
| 10 | 3A | 20180122-HB2 | A*0201 | VLHDDLLEA | | 1,8 | |
| 11 | 3B | 20180122-HB2 | A*0201 | VLHDDLLEA | 0,1 | 0 | |
| 12 | 3C | 20180122-HB2 | A*0201 | VLHDDLLEA | 0,25 | 0 | |
| 13 | 3D | 20180122-HB2 | A*0201 | VLHDDLLEA | 1 | 0 | |
| 14 | 4A | 20180122-HB3 | A*0201 | YLNTKSNGNYEI | | 1,8 | |
| 15 | 4B | 20180122-HB3 | A*0201 | YLNTKSNGNYEI | 0,1 | 0 | |
| 16 | 4C | 20180122-HB3 | A*0201 | YLNTKSNGNYEI | 0,25 | 0 | |
| 17 | 4D | 20180122-HB3 | A*0201 | YLNTKSNGNYEI | 1 | 0 | |
| 18 | 5A | 20180122-HB4 | A*0201 | NMLSTVLGV | | 1,8 | |
| 19 | 5B | 20180122-HB4 | A*0201 | NMLSTVLGV | 0,1 | 0 | |
| 20 | 5C | 20180122-HB4 | A*0201 | NMLSTVLGV | 0,25 | 0 | |
| 21 | 5D | 20180122-HB4 | A*0201 | NMLSTVLGV | 1 | 0 | |
| 22 | 6A | 20180122-HB5 | A*0201 | ALDQTDIRV | | 1,8 | |
| 23 | 6B | 20180122-HB5 | A*0201 | ALDQTDIRV | 0,1 | 0 | |
| 24 | 6C | 20180122-HB5 | A*0201 | ALDQTDIRV | 0,25 | 0 | |
| 25 | 6D | 20180122-HB5 | A*0201 | ALDQTDIRV | 1 | 0 | |

Fig. 2E. IQIEIEQLTDEI (SEQ ID NO:5126)-SHIFT Assay

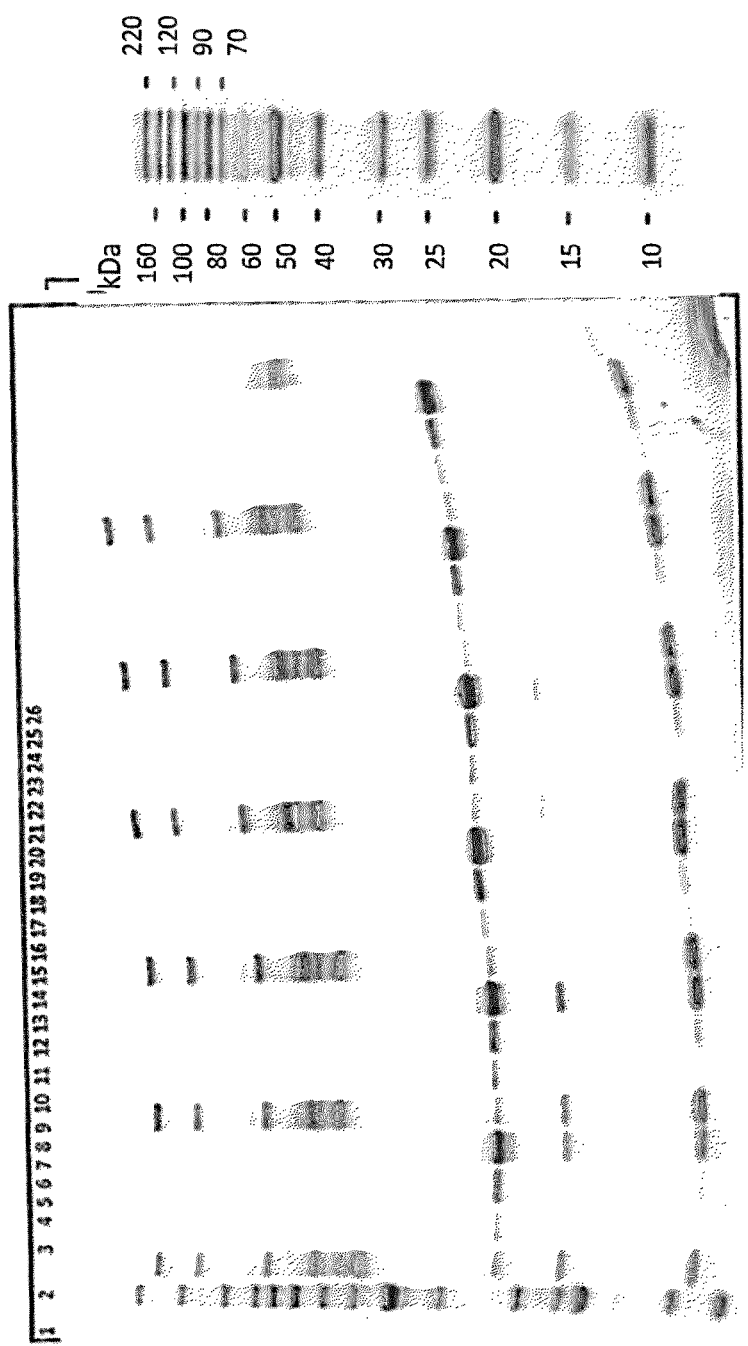
Fig. 2E-1. IQIEIEQLTDEI (SEQ ID NO:5126)-SHIFT Assay

| Lane | Samlpe | Lot | Tung Kæde | Peptid | Foldet MHC/µg | Streptavidin/µg | Control Lane | |
|---|---|---|---|---|---|---|---|---|
| | | | | | | | Streptavidin | 26 |
| | | | | | | | Markør | 1 |
| 2 | 1A | 20161121-LL1 | A*0201 | RMISDQRANLGA | 1 | 1,8 | | |
| 3 | 1B | 20161121-LL1 | A*0201 | RMISDQRANLGA | 0,1 | 0 | | |
| 4 | 1C | 20161121-LL1 | A*0201 | RMISDQRANLGA | 0,25 | 0 | | |
| 5 | 1D | 20161121-LL1 | A*0201 | RMISDQRANLGA | 1 | 0 | | |
| 6 | 2A | 20161121-LL2 | A*0201 | AQIKDATMTDEV | 1 | 1,8 | | |
| 7 | 2B | 20161121-LL2 | A*0201 | AQIKDATMTDEV | 0,1 | 0 | | |
| 8 | 2C | 20161121-LL2 | A*0201 | AQIKDATMTDEV | 0,25 | 0 | | |
| 9 | 2D | 20161121-LL2 | A*0201 | AQIKDATMTDEV | 1 | 0 | | |
| 10 | 3A | 20161121-LL3 | A*0201 | SQGGVNSPV | 1 | 1,8 | | |
| 11 | 3B | 20161121-LL3 | A*0201 | SQGGVNSPV | 0,1 | 0 | | |
| 12 | 3C | 20161121-LL3 | A*0201 | SQGGVNSPV | 0,25 | 0 | | |
| 13 | 3D | 20161121-LL3 | A*0201 | SQGGVNSPV | 1 | 0 | | |
| 14 | 4A | 20161121-LL9 | H-2 Kb | SLGKYGKL | 1 | 1,8 | | |
| 15 | 4B | 20161121-LL9 | H-2 Kb | SLGKYGKL | 0,1 | 0 | | |
| 16 | 4C | 20161121-LL9 | H-2 Kb | SLGKYGKL | 0,25 | 0 | | |
| 17 | 4D | 20161121-LL9 | H-2 Kb | SLGKYGKL | 1 | 0 | | |
| 18 | 5A | 20161121-LL10 | A*2402 | AYSILWDLKF | 1 | 1,8 | | |
| 19 | 5B | 20161121-LL10 | A*2402 | AYSILWDLKF | 0,1 | 0 | | |
| 20 | 5C | 20161121-LL10 | A*2402 | AYSILWDLKF | 0,25 | 0 | | |
| 21 | 5D | 20161121-LL10 | A*2402 | AYSILWDLKF | 1 | 0 | | |
| 22 | 6A | 20161122-HB1 | A*2402 | QYNPIRTTF | 1 | 1,8 | | |
| 23 | 6B | 20161122-HB1 | A*2402 | QYNPIRTTF | 0,1 | 0 | | |
| 24 | 6C | 20161122-HB1 | A*2402 | QYNPIRTTF | 0,25 | 0 | | |
| 25 | 6D | 20161122-HB1 | A*2402 | QYNPIRTTF | 1 | 0 | | |

Fig. 2F. RMISDQRANLGA (SEQ ID NO:5127)-SHIFT Assay

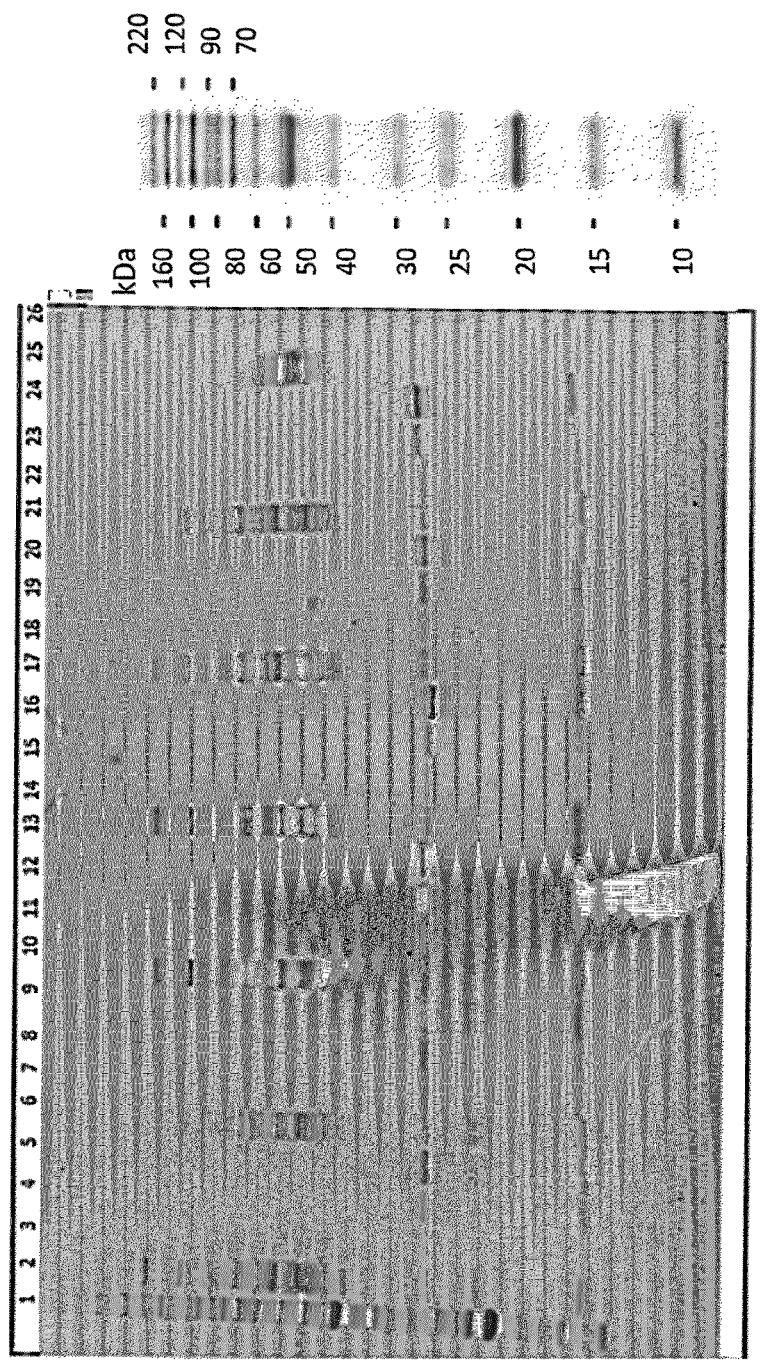
Fig. 2F-1. RMISDQRANLGA (SEQ ID NO:5127)-SHIFT Assay

| Lane | Samlpe | Lot | Tung Kæde | Peptid | Foldet MHC/μg | Streptavidin/μg | Control Lane |
|---|---|---|---|---|---|---|---|
| | | | | | | | Streptavidin 25 |
| | | | | | | | Markør 1 |
| 2 | 1A | 20161121-LL1 | A*0201 | RMISDQRANLGA | 1 | 1,8 | |
| 3 | 1B | 20161121-LL1 | A*0201 | RMISDQRANLGA | 0,1 | 0 | |
| 4 | 1C | 20161121-LL1 | A*0201 | RMISDQRANLGA | 0,25 | 0 | |
| 5 | 1D | 20161121-LL1 | A*0201 | RMISDQRANLGA | 1 | 0 | |
| 6 | 2A | 20161121-LL2 | A*0201 | AQIKDATMTDEV | 1 | 1,8 | |
| 7 | 2B | 20161121-LL2 | A*0201 | AQIKDATMTDEV | 0,1 | 0 | |
| 8 | 2C | 20161121-LL2 | A*0201 | AQIKDATMTDEV | 0,25 | 0 | |
| 9 | 2D | 20161121-LL2 | A*0201 | AQIKDATMTDEV | 1 | 0 | |
| 10 | 3A | 20161121-LL3 | A*0201 | SQGGVNSPV | 1 | 1,8 | |
| 11 | 3B | 20161121-LL3 | A*0201 | SQGGVNSPV | 0,1 | 0 | |
| 12 | 3C | 20161121-LL3 | A*0201 | SQGGVNSPV | 0,25 | 0 | |
| 13 | 3D | 20161121-LL3 | A*0201 | SQGGVNSPV | 1 | 0 | |
| 14 | 4A | 20161121-LL9 | H-2 Kb | SLGKYGKL | 1 | 1,8 | |
| 15 | 4B | 20161121-LL9 | H-2 Kb | SLGKYGKL | 0,1 | 0 | |
| 16 | 4C | 20161121-LL9 | H-2 Kb | SLGKYGKL | 0,25 | 0 | |
| 17 | 4D | 20161121-LL9 | H-2 Kb | SLGKYGKL | 1 | 0 | |
| 18 | 5A | 20161121-LL10 | A*2402 | AYSILWDLKF | 1 | 1,8 | |
| 19 | 5B | 20161121-LL10 | A*2402 | AYSILWDLKF | 0,1 | 0 | |
| 20 | 5C | 20161121-LL10 | A*2402 | AYSILWDLKF | 0,25 | 0 | |
| 21 | 5D | 20161121-LL10 | A*2402 | AYSILWDLKF | 1 | 0 | |
| 22 | 6A | 20161122-HB1 | A*2402 | QYNPIRTTF | 1 | 1,8 | |
| 23 | 6B | 20161122-HB1 | A*2402 | QYNPIRTTF | 0,1 | 0 | |
| 24 | 6C | 20161122-HB1 | A*2402 | QYNPIRTTF | 0,25 | 0 | |
| 25 | 6D | 20161122-HB1 | A*2402 | QYNPIRTTF | 1 | 0 | |

Fig. 2G. SQGGVNSPV (SEQ ID NO:5344)-SHIFT Assay

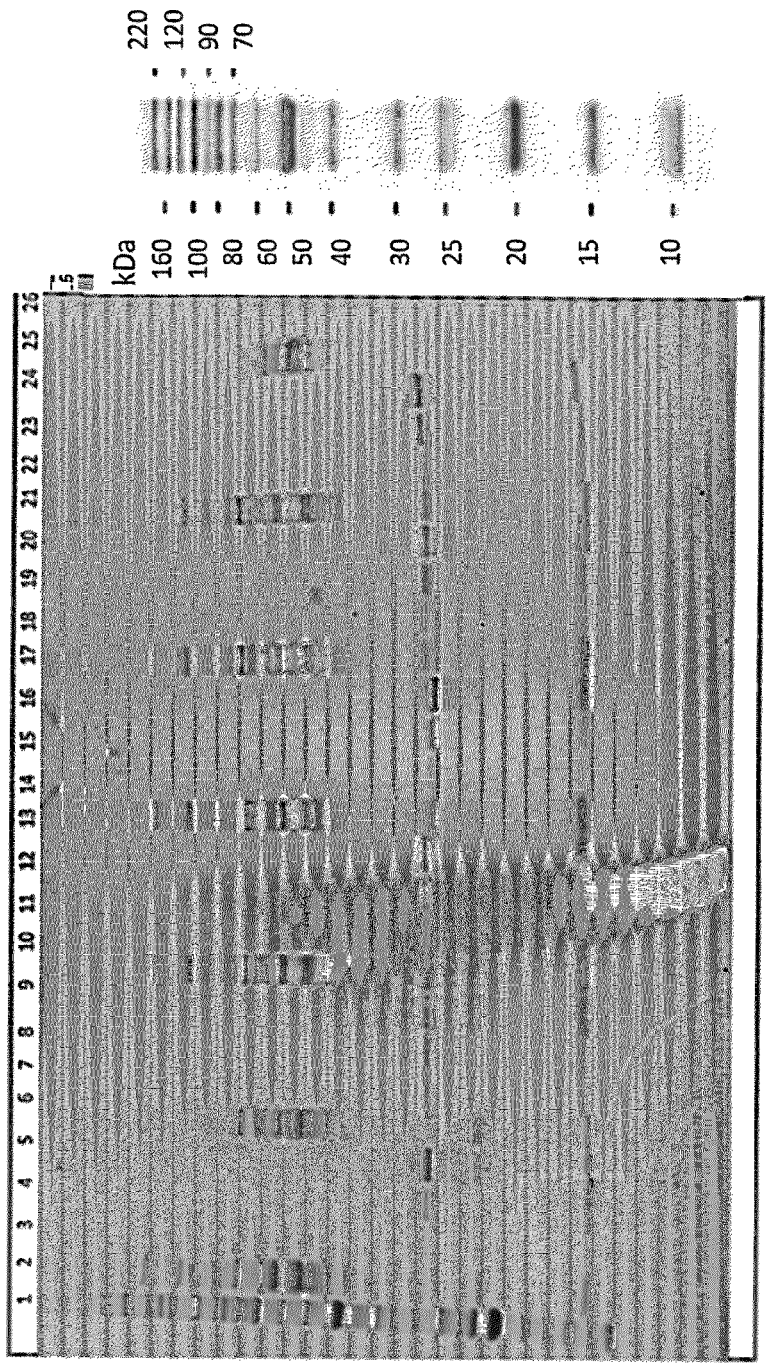
Fig. 2G-1. SQGGVNSPV (SEQ ID NO:5344)-SHIFT Assay

| Lane | Sample no. | Lot no. | Heavy chain | Peptide seq. | μg Folded MHC | μg Streptavidin | Control | Lane |
|---|---|---|---|---|---|---|---|---|
| | | | | | | | Marker | 1 |
| | | | | | | | Streptavidin | 22 |
| 2 | 7A | 20180710-HB2 | A*0201 | RMISDQRANLGA | 1 | 1,8 | | |
| 3 | 7B | 20180710-HB2 | A*0201 | RMISDQRANLGA | 0,1 | 0 | | |
| 4 | 7C | 20180710-HB2 | A*0201 | RMISDQRANLGA | 0,25 | 0 | | |
| 5 | 7D | 20180710-HB2 | A*0201 | RMISDQRANLGA | 1 | 0 | | |
| 6 | 8A | 20180710-HB3 | A*0201 | MLDEAKDKL | 1 | 1,8 | | |
| 7 | 8B | 20180710-HB3 | A*0201 | MLDEAKDKL | 0,1 | 0 | | |
| 8 | 8C | 20180710-HB3 | A*0201 | MLDEAKDKL | 0,25 | 0 | | |
| 9 | 8D | 20180710-HB3 | A*0201 | MLDEAKDKL | 1 | 0 | | |
| 10 | 9A | 20180710-HB4 | B*0702 | QPEWFRNVL | 1 | 1,8 | | |
| 11 | 9B | 20180710-HB4 | B*0702 | QPEWFRNVL | 0,1 | 0 | | |
| 12 | 9C | 20180710-HB4 | B*0702 | QPEWFRNVL | 0,25 | 0 | | |
| 13 | 9D | 20180710-HB4 | B*0702 | QPEWFRNVL | 1 | 0 | | |
| 14 | 10A | 20180710-HB5 | A*0201 | KLHLYSHPI | 1 | 1,8 | | |
| 15 | 10B | 20180710-HB5 | A*0201 | KLHLYSHPI | 0,1 | 0 | | |
| 16 | 10C | 20180710-HB5 | A*0201 | KLHLYSHPI | 0,25 | 0 | | |
| 17 | 10D | 20180710-HB5 | A*0201 | KLHLYSHPI | 1 | 0 | | |
| 18 | 11A | 20180710-HB6 | A*0201 | GLSRYVARL | 1 | 1,8 | | |
| 19 | 11B | 20180710-HB6 | A*0201 | GLSRYVARL | 0,1 | 0 | | |
| 20 | 11C | 20180710-HB6 | A*0201 | GLSRYVARL | 0,25 | 0 | | |
| 21 | 11D | 20180710-HB6 | A*0201 | GLSRYVARL | 1 | 0 | | |
| | 12A | | 0 | 0 | | 1,8 | | |
| | 12B | | 0 | 0 | | 0 | | |
| | 12C | | 0 | 0 | | 0 | | |
| | 12D | | | | | | | |

Fig. 2H. MLDEAKDKL (SEQ ID NO:5516)-SHIFT Assay

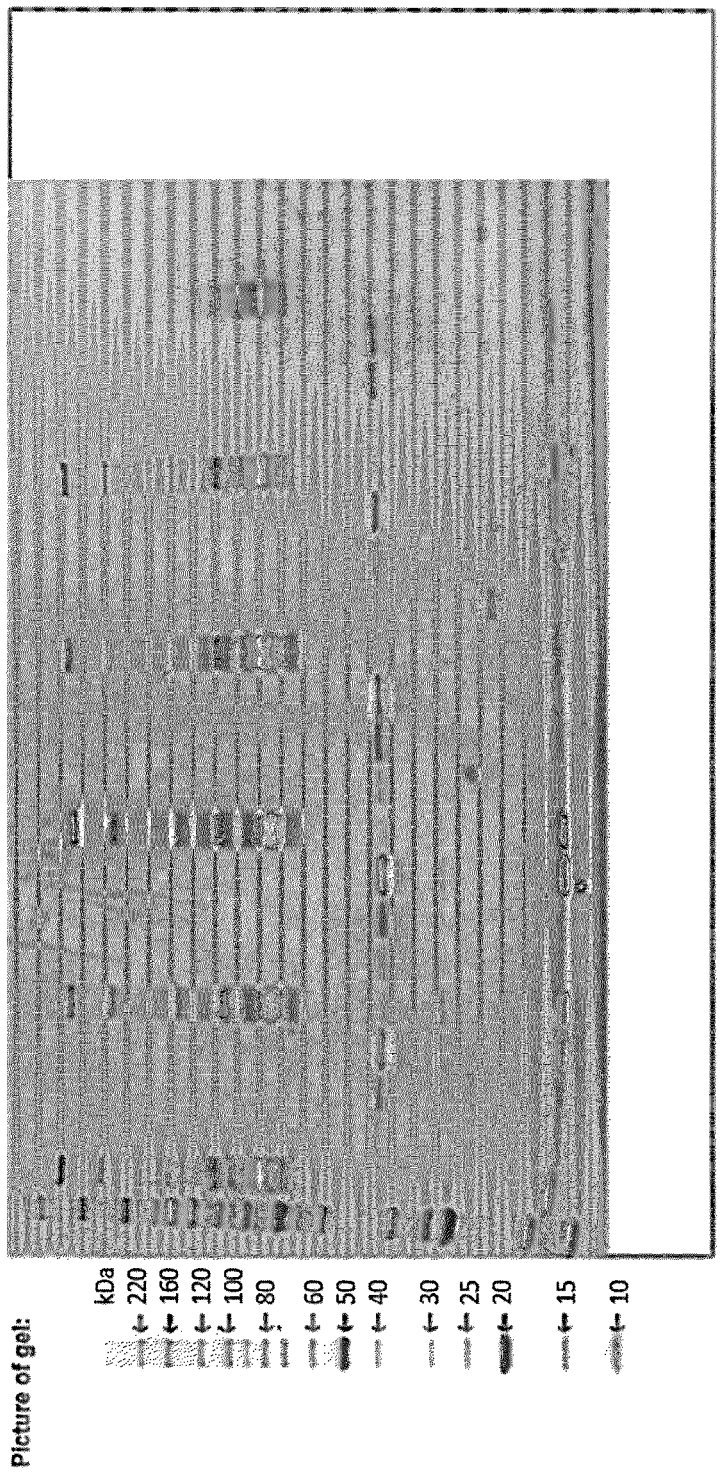
Fig. 2H-1. MLDEAKDKL (SEQ ID NO:5516)-SHIFT Assay

| Lane | Samlpe | Lot | Tung Kæde | Peptid | Foldet MHC/µg | Streptavidin/µg | Control Lane | |
|---|---|---|---|---|---|---|---|---|
| | | | | | | | Streptavidin | 26 |
| | | | | | | | Markør | 1 |
| 2 | 1A | 20180123-HB5 | A*0201 | FMEQATNSWI | 1 | 1,8 | | |
| 3 | 1B | 20180123-HB5 | A*0201 | FMEQATNSWI | 0,1 | 0 | | |
| 4 | 1C | 20180123-HB5 | A*0201 | FMEQATNSWI | 0,25 | 0 | | |
| 5 | 1D | 20180123-HB5 | A*0201 | FMEQATNSWI | 1 | 0 | | |
| 6 | 2A | 20180123-HB6 | A*0201 | YIKDINEFI | 1 | 1,8 | | |
| 7 | 2B | 20180123-HB6 | A*0201 | YIKDINEFI | 0,1 | 0 | | |
| 8 | 2C | 20180123-HB6 | A*0201 | YIKDINEFI | 0,25 | 0 | | |
| 9 | 2D | 20180123-HB6 | A*0201 | YIKDINEFI | 1 | 0 | | |
| 10 | 3A | 20180129-HB1 | A*0201 | NLVPMVATV | 1 | 1,8 | | |
| 11 | 3B | 20180129-HB1 | A*0201 | NLVPMVATV | 0,1 | 0 | | |
| 12 | 3C | 20180129-HB1 | A*0201 | NLVPMVATV | 0,25 | 0 | | |
| 13 | 3D | 20180129-HB1 | A*0201 | NLVPMVATV | 1 | 0 | | |
| 14 | 4A | 20180129-HB2 | A*0201 | NLVPMVATV | 1 | 1,8 | | |
| 15 | 4B | 20180129-HB2 | A*0201 | NLVPMVATV | 0,1 | 0 | | |
| 16 | 4C | 20180129-HB2 | A*0201 | NLVPMVATV | 0,25 | 0 | | |
| 17 | 4D | 20180129-HB2 | A*0201 | NLVPMVATV | 1 | 0 | | |
| 18 | 5A | 20180129-HB3 | A*0201 | ALDQTDIRV | 1 | 1,8 | | |
| 19 | 5B | 20180129-HB3 | A*0201 | ALDQTDIRV | 0,1 | 0 | | |
| 20 | 5C | 20180129-HB3 | A*0201 | ALDQTDIRV | 0,25 | 0 | | |
| 21 | 5D | 20180129-HB3 | A*0201 | ALDQTDIRV | 1 | 0 | | |
| 22 | 6A | 20180129-HB4 | A*0201 | YLYHRVDVI | 1 | 1,8 | | |
| 23 | 6B | 20180129-HB4 | A*0201 | YLYHRVDVI | 0,1 | 0 | | |
| 24 | 6C | 20180129-HB4 | A*0201 | YLYHRVDVI | 0,25 | 0 | | |
| 25 | 6D | 20180129-HB4 | A*0201 | YLYHRVDVI | 1 | 0 | | |

Fig. 2I. FMEQATNSWI (SEQ ID NO:5530)-SHIFT Assay

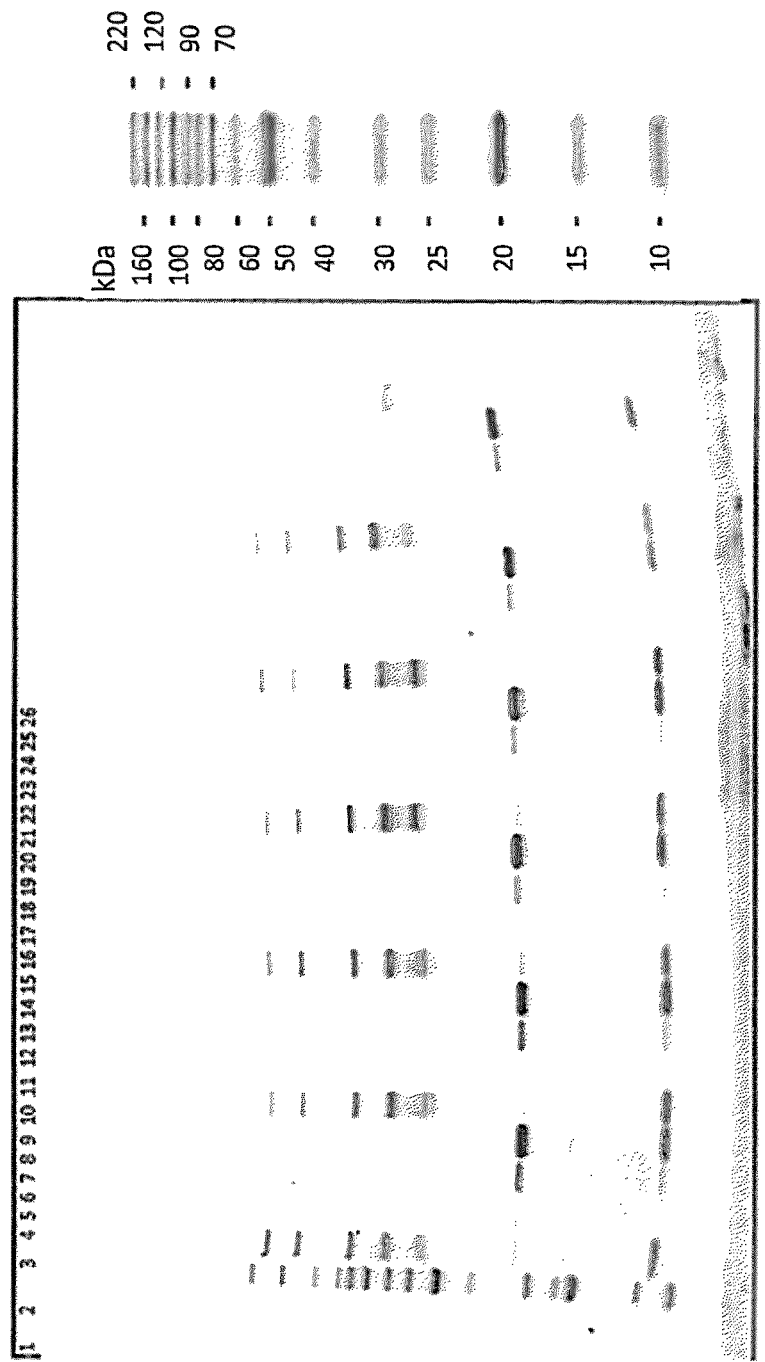
Fig. 2I-1. FMEQATNSWI (SEQ ID NO:5530)-SHIFT Assay

| Lane | Samlpe | Lot | Tung Kæde | Peptid | Foldet MHC/μg | Streptavidin/μg | Control Lane |
|---|---|---|---|---|---|---|---|
| | | | | | | | Streptavidin 26 |
| | | | | | | | Markør 1 |
| 2 | 1A | 20161121-LL4 | A*0201 | MLDEAKDKL | 1 | 1,8 | |
| 3 | 1B | 20161121-LL4 | A*0201 | MLDEAKDKL | 0,1 | 0 | |
| 4 | 1C | 20161121-LL4 | A*0201 | MLDEAKDKL | 0,25 | 0 | |
| 5 | 1D | 20161121-LL4 | A*0201 | MLDEAKDKL | 1 | 0 | |
| 6 | 2A | 20161121-LL5 | A*0201 | FMEQATNSWI | 1 | 1,8 | |
| 7 | 2B | 20161121-LL5 | A*0201 | FMEQATNSWI | 0,1 | 0 | |
| 8 | 2C | 20161121-LL5 | A*0201 | FMEQATNSWI | 0,25 | 0 | |
| 9 | 2D | 20161121-LL5 | A*0201 | FMEQATNSWI | 1 | 0 | |
| 10 | 3A | 20161121-LL6 | A*0201 | NLVFSSLFL | 1 | 1,8 | |
| 11 | 3B | 20161121-LL6 | A*0201 | NLVFSSLFL | 0,1 | 0 | |
| 12 | 3C | 20161121-LL6 | A*0201 | NLVFSSLFL | 0,25 | 0 | |
| 13 | 3D | 20161121-LL6 | A*0201 | NLVFSSLFL | 1 | 0 | |
| 14 | 4A | 20161121-LL7 | A*0201 | KLAESIYKRL | 1 | 1,8 | |
| 15 | 4B | 20161121-LL7 | A*0201 | KLAESIYKRL | 0,1 | 0 | |
| 16 | 4C | 20161121-LL7 | A*0201 | KLAESIYKRL | 0,25 | 0 | |
| 17 | 4D | 20161121-LL7 | A*0201 | KLAESIYKRL | 1 | 0 | |
| 18 | 5A | 20161121-LL8 | A*0201 | YIKDINEFI | 1 | 1,8 | |
| 19 | 5B | 20161121-LL8 | A*0201 | YIKDINEFI | 0,1 | 0 | |
| 20 | 5C | 20161121-LL8 | A*0201 | YIKDINEFI | 0,25 | 0 | |
| 21 | 5D | 20161121-LL8 | A*0201 | YIKDINEFI | 1 | 0 | |
| 22 | 6A | 20161123-HB1 | H-2 Kb | CVYEHTAVL | 1 | 1,8 | |
| 23 | 6B | 20161123-HB1 | H-2 Kb | CVYEHTAVL | 0,1 | 0 | |
| 24 | 6C | 20161123-HB1 | H-2 Kb | CVYEHTAVL | 0,25 | 0 | |
| 25 | 6D | 20161123-HB1 | H-2 Kb | CVYEHTAVL | 1 | 0 | |

Fig. 2J. NLVFSSLFL (SEQ ID NO:5510)-SHIFT Assay

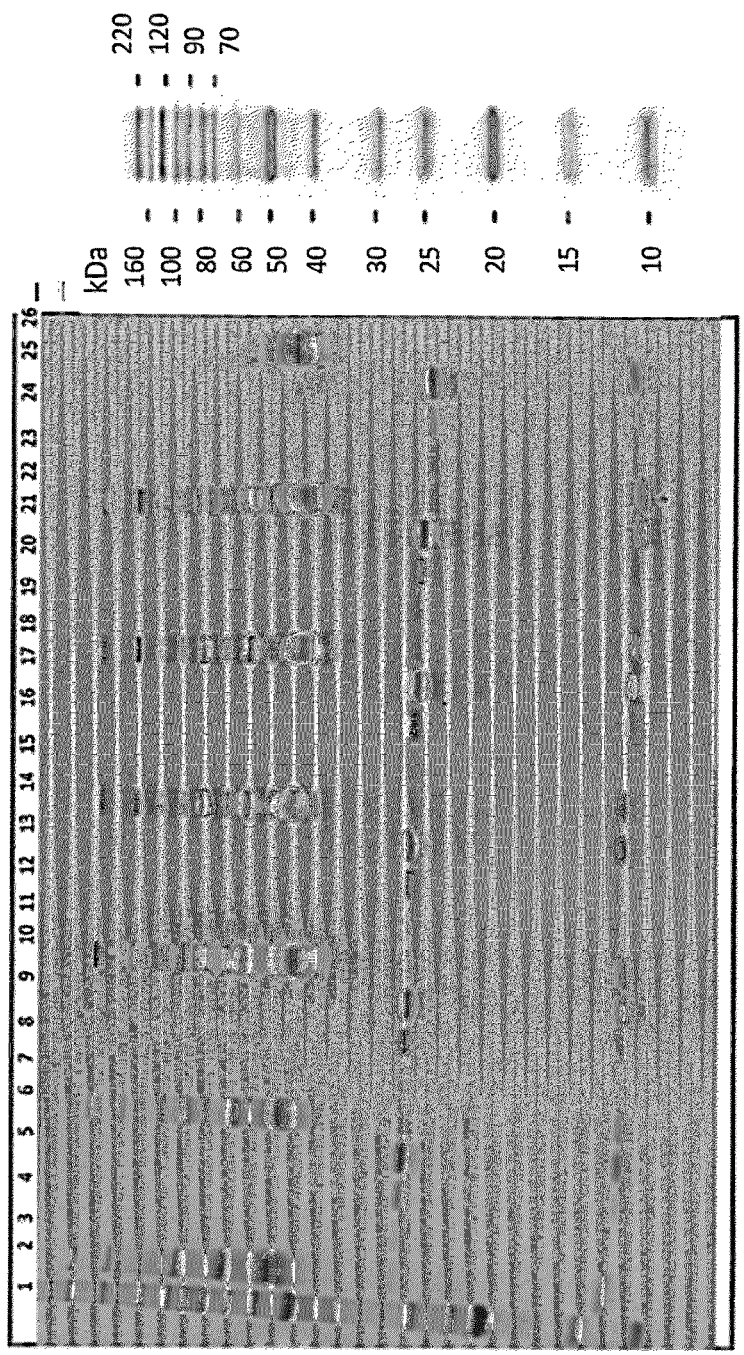
Fig. 2J-1. NLVFSSLFL (SEQ ID NO:5510)-SHIFT Assay

| Lane | Samlpe | Lot | Tung Kæde | Peptid | Foldet MHC/µg Streptavidin/µg | Control Lane | |
|---|---|---|---|---|---|---|---|
| | | | | | | Streptavidin | 26 |
| | | | | | | Markør | 1 |
| 2 | 1A | 20180205-LL1 | A0201 | NLVPMVATV | 1 | | |
| 3 | 1B | 20180205-LL1 | A0201 | NLVPMVATV | 0,1 | | |
| 4 | 1C | 20180205-LL1 | A0201 | NLVPMVATV | 0,25 | | |
| 5 | 1D | 20180205-LL1 | A0201 | NLVPMVATV | 1 | | |
| 6 | 2A | 20180205-LL2 | A0201 | NLVPMVATV | 1 | | |
| 7 | 2B | 20180205-LL2 | A0201 | NLVPMVATV | 0,1 | | |
| 8 | 2C | 20180205-LL2 | A0201 | NLVPMVATV | 0,25 | | |
| 9 | 2D | 20180205-LL2 | A0201 | NLVPMVATV | 1 | | |
| 10 | 3A | 20180205-LL3 | A0201 | ALIAPVHAV | 1 | | |
| 11 | 3B | 20180205-LL3 | A0201 | ALIAPVHAV | 0,1 | | |
| 12 | 3C | 20180205-LL3 | A0201 | ALIAPVHAV | 0,25 | | |
| 13 | 3D | 20180205-LL3 | A0201 | ALIAPVHAV | 1 | | |
| 14 | 4A | 20180205-LL4 | A0201 | SITEVECFL | 1 | | |
| 15 | 4B | 20180205-LL4 | A0201 | SITEVECFL | 0,1 | | |
| 16 | 4C | 20180205-LL4 | A0201 | SITEVECFL | 0,25 | | |
| 17 | 4D | 20180205-LL4 | A0201 | SITEVECFL | 1 | | |
| 18 | 5A | 20180205-LL5 | A0201 | KLAESIYKRL | 1 | | |
| 19 | 5B | 20180205-LL5 | A0201 | KLAESIYKRL | 0,1 | | |
| 20 | 5C | 20180205-LL5 | A0201 | KLAESIYKRL | 0,25 | | |
| 21 | 5D | 20180205-LL5 | A0201 | KLAESIYKRL | 1 | | |
| 22 | 6A | 20180207-HB1 | H2 Kd | SYVKVLEYV | 1 | | |
| 23 | 6B | 20180207-HB1 | H2 Kd | SYVKVLEYV | 0,1 | | |
| 24 | 6C | 20180207-HB1 | H2 Kd | SYVKVLEYV | 0,25 | | |
| 25 | 6D | 20180207-HB1 | H2 Kd | SYVKVLEYV | 1 | | |

Fig. 2K. KLAESIYKRL (SEQ ID NO:5531)-SHIFT Assay

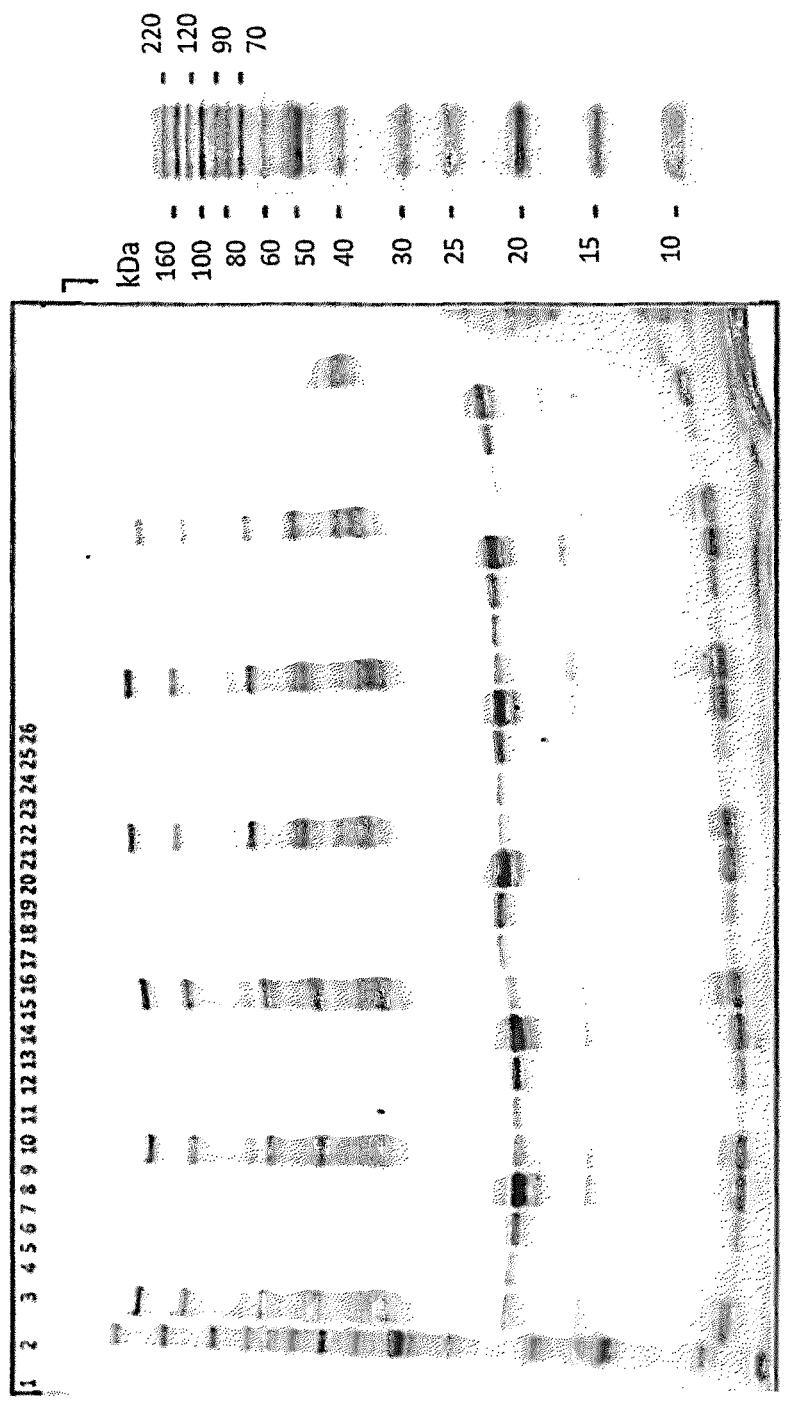
Fig. 2K-1. KLAESIYKRL (SEQ ID NO:5531)-SHIFT Assay

A
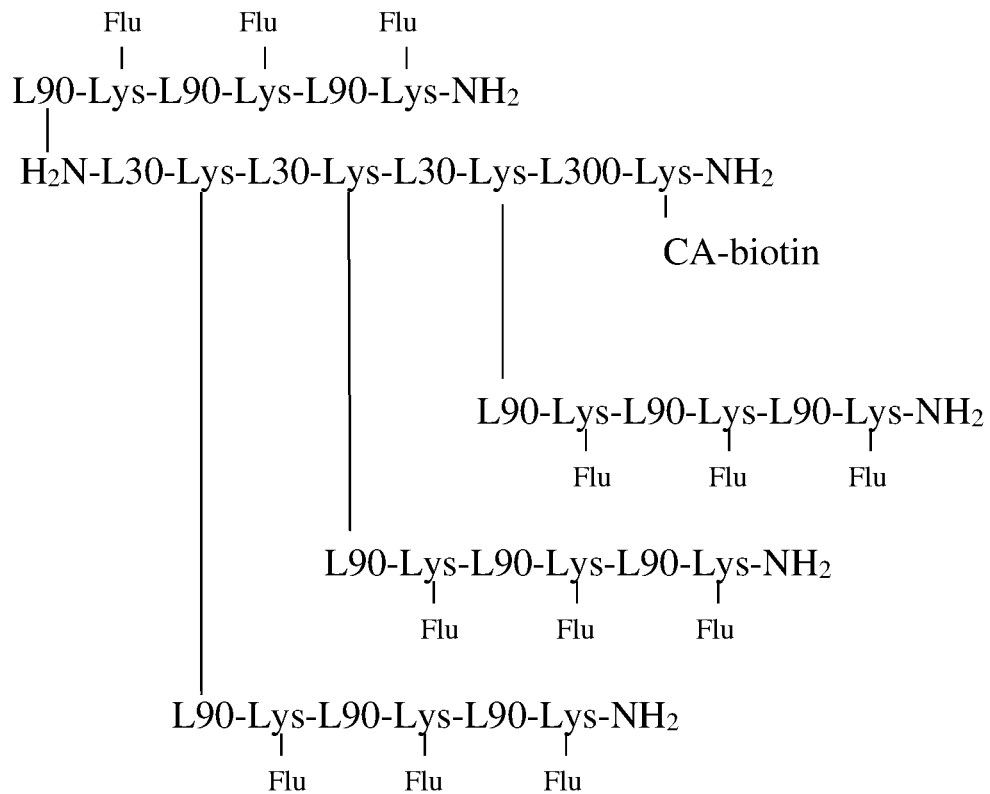
B
L15 linker composition:
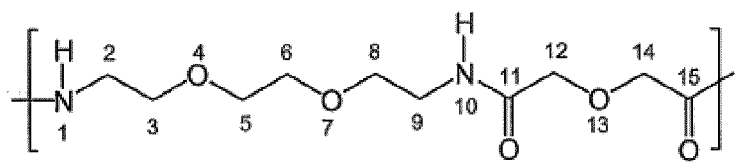
Fig. 3

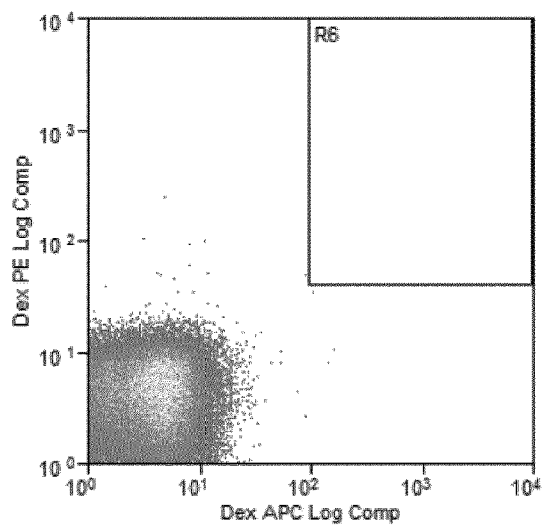
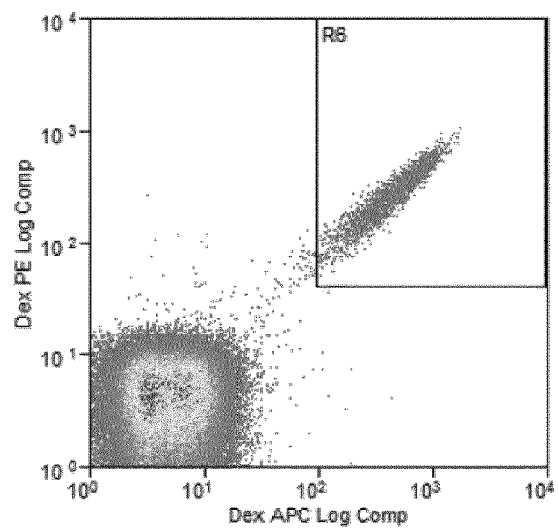
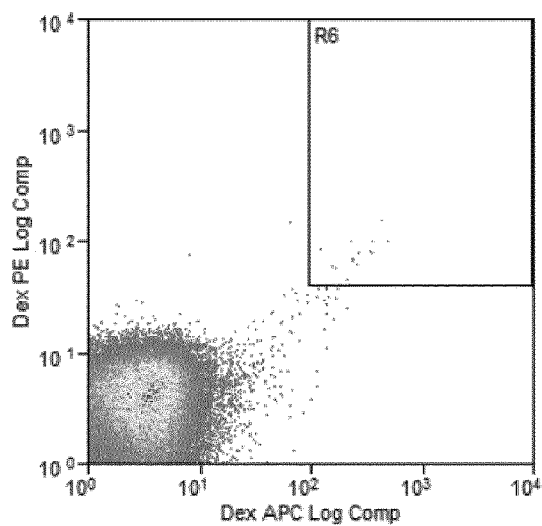
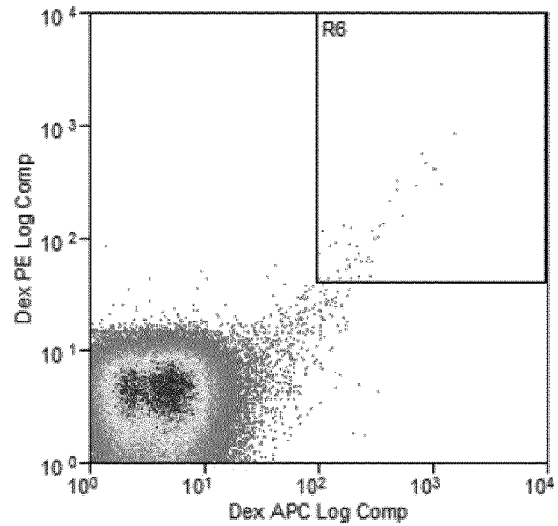
Fig. 4 A

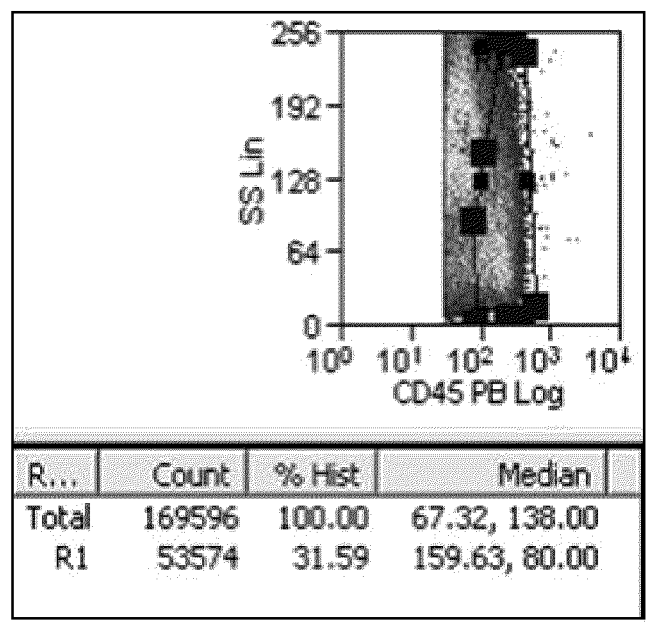
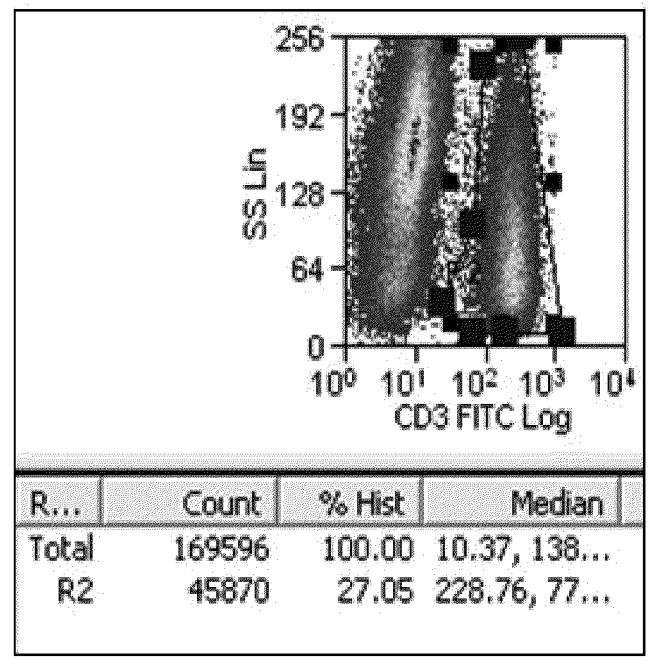
Fig. 5. Gating strategy for no-lyse no-wash procedure

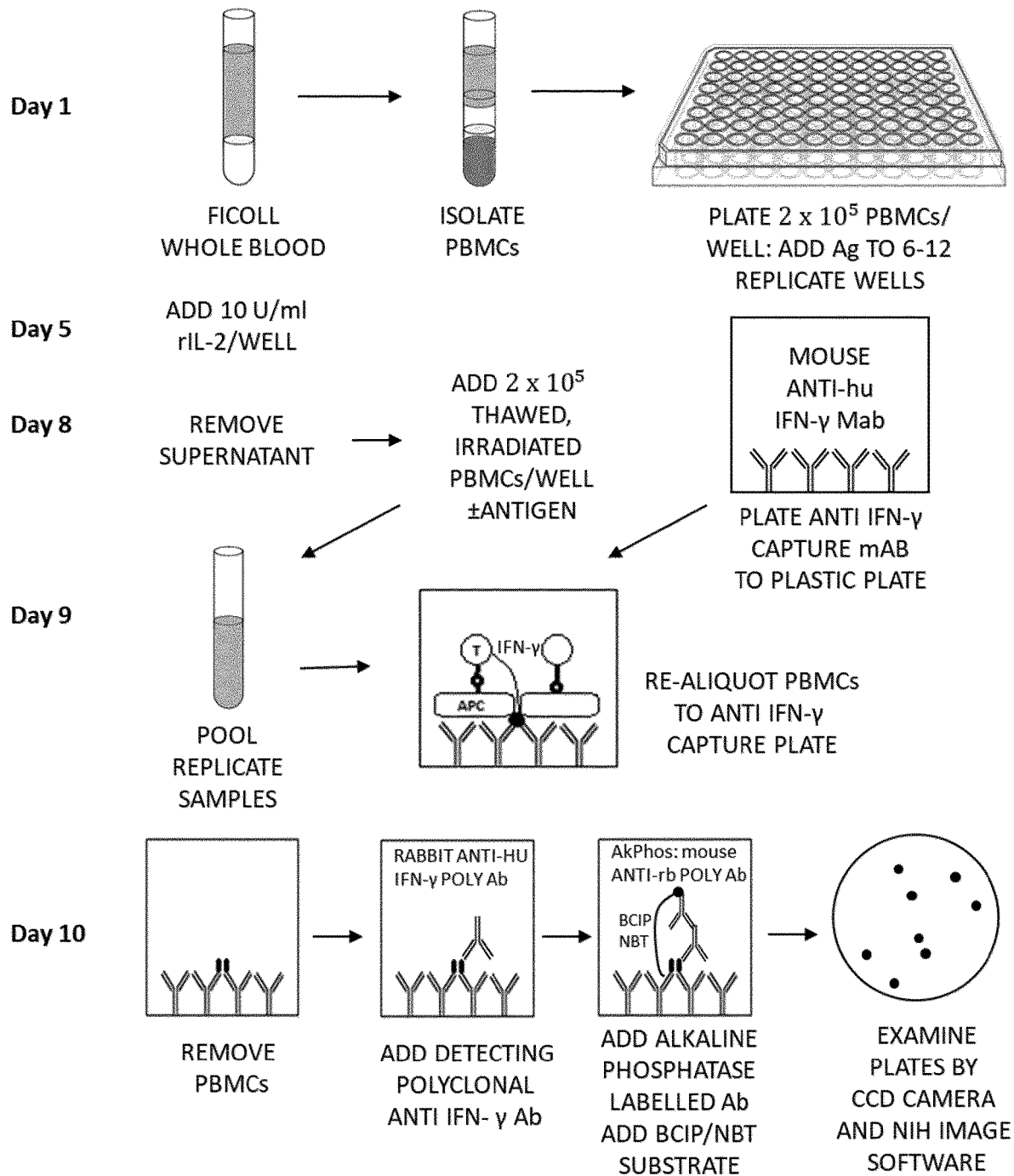
Fig. 6. Summary flow chart ELISPOT

PANEL COMPRISING *BORRELIA* MHC MULTIMERS

All patent and non-patent references cited in the present application, are hereby incorporated by reference in their entirety.

TECHNICAL FIELD

The present disclosure relates to a panel comprising one or more MHC multimers; and a panel comprising one or more pools of MHC multimers, wherein each pool comprises one or more MHC multimers; wherein said MHC multimers comprise an antigenic peptide P derived from a *Borrelia* antigenic polypeptide selected from the group consisting of OppA, DbpA, FlhF, FlaB and P37-42; as well as uses thereof in the detection of *Borrelia*-specific T cells and the diagnosis, treatment and monitoring of *Borrelia* disease in an individual.

BACKGROUND

The adaptive immune system is directed through specific interactions between immune cells and antigen-presenting cells (e.g. dendritic cells, B-cells, monocytes and macrophages) or target cells (e.g. virus infected cells, bacteria infected cells or cancer cells). In important field in immunology relates to the understanding of the molecular interaction between an immune cell and the target cell.

Specifically for T-lymphocytes (T-cells), this interaction is mediated through binding between a clonotypic T-cell receptor (TCR) and the Major Histocompatibility Complex (MHC) class I or class II, called human leukocyte antigens (HLA) in man. The MHC molecules carries a peptide cargo—antigenic peptide epitope, and this peptide is decisive for T-cell recognition. Depending on the type of pathogen, being intracellular or extracellular, the antigenic peptides are bound to MHC class I or MHC class II, respectively. The two classes of MHC complexes are recognized by different subsets of T cells; Cytotoxic CD8+ T cells recognizing MHC class I and CD4+ helper cells recognizing MHC class II. In general, TCR recognition of MHC-peptide complexes result in T cell activation, clonal expansion and differentiation of the T cells into effector, memory and regulatory T cells.

MHC complexes function as antigenic peptide receptors, collecting peptides inside the cell and transporting them to the cell surface, where the MHC-peptide complex can be recognized by T-lymphocytes. Two classes of classical MHC complexes exist, MHC class I and II. The most important difference between these two molecules lies in the protein source from which they obtain their associated peptides. MHC class I molecules present peptides derived from endogenous antigens degraded in the cytosol and are thus able to display fragments of viral proteins and unique proteins derived from cancerous cells. Almost all nucleated cells express MHC class I on their surface even though the expression level varies among different cell types. MHC class II molecules bind peptides derived from exogenous antigens. Exogenous proteins enter the cells by endocytosis or phagocytosis, and these proteins are degraded by proteases in acidified intracellular vesicles before presentation by MHC class II molecules. MHC class II molecules are only expressed on professional antigen presenting cells like B cells and macrophages.

The three-dimensional structure of MHC class I and II molecules are very similar but important differences exist. MHC class I molecules consist of two polypeptide chains, a heavy chain, α, spanning the membrane and a light chain, β2-microglobulin (β2m). The heavy chain is encoded in the gene complex termed the major histocompatibility complex (MHC), and its extracellular portion comprises three domains, α1, α2 and α3. The β2m chain is not encoded in the MHC gene and consists of a single domain, which together with the α3 domain of the heavy chain make up a folded structure that closely resembles that of the immunoglobulin. The α1 and α2 domains pair to form the peptide binding cleft, consisting of two segmented a helices lying on a sheet of eight p-strands. In humans as well as in mice three different types of MHC class I molecule exist. HLA-A, B, C are found in humans while MHC class I molecules in mice are designated H-2K, H-2D and H-2L.

A remarkable feature of MHC genes is their polymorphism accomplished by multiple alleles at each gene. The polygenic and polymorphic nature of MHC genes is reflected in the peptide-binding cleft so that different MHC complexes bind different sets of peptides. The variable amino acids in the peptide binding cleft form pockets where the amino acid side chains of the bound peptide can be buried. This permits a specific variant of MHC to bind some peptides better than others.

Due to the short half-life of the peptide-MHC-T cell receptor ternary complex (typically between 10 and 25 seconds) it is difficult to label specific T cells with labelled MHC-peptide complexes, and like-wise, it is difficult to employ such monomers of MHC-peptide for therapeutic and vaccine purposes because of their weak binding. In order to circumvent this problem, MHC multimers have been developed. These are complexes that include multiple copies of MHC-peptide complexes, providing these complexes with an increased affinity and half-life of interaction, compared to that of the monomer MHC-peptide complex. The multiple copies of MHC-peptide complexes are attached, covalently or non-covalently, to a multimerization domain. Known examples of such MHC multimers include MHC-dimers with an IgG-multimerization domain, MHC-tetramers in complex with a streptavidin tetramer protein (U.S. Pat. No. 5,635,363), MHC pentamers with a self-assembling coiled-coil domain (US 2004209295), MHC streptamers having 8-12 MHC molecules attached to streptactin, and MHC dextramers having a larger number of MHC-peptide complexes, typically more than ten, attached to a dextran polymer.

The understanding of T-cell recognition experienced a dramatic technological breakthrough with the discovery in 1996 that multimerization of single peptide-MHC molecules into tetramers would allow sufficient binding-strength (avidity) between the peptide-MHC molecules and the TCR to determine this interaction through a fluorescence label attached to the MHC-multimer. Fluorescent-labelled MHC multimers (of both class I and class II molecules) are now widely used for detecting T-cells and determining T-cell specificity. The MHC multimer associated fluorescence can be determined by e.g. flow cytometry or microscopy, or T-cells can be selected based on this fluorescence label through e.g. flow cytometry or bead-based sorting. The MHC multimer techniques have since been developed e.g. to enable the detection of low-affinity T-cells by the provision of MHC multimers with a flexible backbone, namely the MHC dextramer technology (see e.g. WO 2002/072631), and to better match the enormous diversity in T-cell recognition with the aim to enable detection of multiple different T-cell specificities in a single sample. Multiplex detection of antigen specific T-cells may be achieved with combinatorial encoded MHC multimers using a combinatorial fluorescence labelling approach that allows for the detection of numerous different T-cell populations in a single sample, and more recently with the use of nucleotide-labelling of MHC multimers (WO 2015/188839 & WO 2015/185067). WO 2009/106073 discloses MHC complexes comprising *Borrelia* peptides.

SUMMARY

Measurement of antigen-specific T cells during an immune response are important parameters in vaccine development, therapy and infectious diseases, inflammation, autoimmunity, toxicity studies etc. MHC multimers are crucial reagents in monitoring of antigen-specific T cells.

It is an aspect of the present invention to provide a panel comprising one or more MHC multimers comprising $(a\text{-}b\text{-}P)_n$, wherein $n>1$,
   wherein polypeptides a and b together form a functional MHC protein capable of binding peptide P, and (a-b-P) is a MHC-peptide complex formed when peptide P binds to the functional MHC protein,
   wherein each MHC-peptide complex of a MHC multimer is associated with one or more multimerization domains;
   wherein each MHC multimer comprises an antigenic peptide P derived from a *Borrelia* antigenic polypeptide selected from the group consisting of OppA, DbpA, FlhF, FlaB and P37-42.

It is also an aspect of the present invention to provide a panel comprising one or more pools of MHC multimers comprising $(a\text{-}b\text{-}P)_n$, wherein $n>1$,
   wherein polypeptides a and b together form a functional MHC protein capable of binding peptide P, and (a-b-P) is a MHC-peptide complex formed when peptide P binds to the functional MHC protein,
   wherein each MHC-peptide complex of a MHC multimer is associated with one or more multimerization domains;
   wherein each pool comprises one or more MHC multimers each comprising an antigenic peptide P derived from a *Borrelia* antigenic polypeptide selected from the group consisting of OppA, DbpA, FlhF, FlaB and P37-42.

In one embodiment the individual antigenic peptides P of each MHC-peptide complex of said MHC multimer in said panel comprising one or more MHC multimers, and in said panel comprising one or more pools of MHC multimers, are identical.

In one embodiment the individual antigenic peptides P of each MHC-peptide complex of said MHC multimer in said panel comprising one or more MHC multimers, and in said panel comprising one or more pools of MHC multimers, are different.

In one embodiment said MHC protein is MHC Class I, and the antigenic peptides P are selected from the group consisting of 8-, 9-, 10,- 11-, and 12-mer peptides that binds to MHC Class I.

It is also an aspect of the present invention to provide a method for generating the MHC multimers in said panels and pools, a method for immune monitoring of a *Borrelia* disease, a method for diagnosing a *Borrelia* disease, a method for isolation of one or more antigen-specific T cells, and a method for detecting an antigen-specific T cell response.

DESCRIPTION OF DRAWINGS

FIG. 1. Size-exclusion chromatography of folded HLA-A*0201-β2m-peptide-complex. Purification of HLA-A*0201-β2m-peptide-complex by size exclusion chromatography on a HiLoad 16/60 Superdex 75 column. Eluted protein was followed by measurement of the absorbance at 280 nm. The elution profile consisted of 4 peaks, corresponding to aggregated Heavy Chain, correctly folded MHC-complex, β2m and excess biotin and peptide. A) HLA-A*0201-β2m-YLNTKSNGNYEI (SEQ ID NO: 359) peptide-complex; B) HLA-A*0201-β2m-FLSIFTQGYT (SEQ ID NO: 241) HLA-A*0201-β2m-FLSIFTQGYT (SEQ ID NO: 241) peptide-complex; C) HLA-A*0201-β2m-GIYDLILNA (SEQ ID NO: 2761) peptide-complex; D) HLA-A*0201-β2m-YIKDINEFI (SEQ ID NO: 4479) peptide-complex; E) HLA-A*0201-β2m-IQIEIEQLTDEI (SEQ ID NO: 5126) peptide-complex; F) HLA-A*0201-R2m-RMISDQRANLGA (SEQ ID NO: 5127) peptide-complex; G) HLA-A*0201-β2m-SQGGVNSPV (SEQ ID NO: 5112) peptide-complex; H) HLA-A*0201-β2m-MLDEAKDKL (SEQ ID NO: 5516) peptide-complex; I) HLA-A*0201-β2m-FMEQATNSWI (SEQ ID NO: 5530) peptide-complex; J) HLA-A*0201-β2m-NLVFSSLFL (SEQ ID NO: 5510) peptide-complex; K) HLA-A*0201-β2m-KLAESIYKRL (SEQ ID NO: 5531) peptide-complex.

FIG. 2. MHC-SHIFT assay. The degree of biotinylation of MHC-peptide monomer is determined by comparing the intensity of the heavy chain band that has not shifted (30-40 kDa) in the lane containing 1.0 µg MHC+1.8 µg streptavidin with the intensity of the heavy chain band in the lanes containing 0.1, 0.25 and 1.0 µg MHC without streptavidin. A) MHC-YLNTKSNGNYEI (SEQ ID NO: 359) monomer; B) MHC-FLSIFTQGYT (SEQ ID NO: 241) monomer; C) MHC-GIYDLILNA (SEQ ID NO: 2761) monomer; D) MHC-YIKDINEFI (SEQ ID NO: 4479) monomer; E) MHC-IQIEIEQLTDEI (SEQ ID NO: 5126) monomer; F) MHC-RMISDQRANLGA (SEQ ID NO: 5127) monomer; G) MHC-SQGGVNSPV (SEQ ID NO: 5112) monomer; H) MHC-MLDEAKDKL (SEQ ID NO: 5516) monomer; I) MHC-FMEQATNSWI (SEQ ID NO: 5530) monomer; J) MHC-NLVFSSLFL (SEQ ID NO: 5510) monomer; K) MHC-KLAESIYKRL (SEQ ID NO: 5531) monomer.

FIG. 3. Composition of Fluorescein-linker molecule. (A) Schematic presentation of an example of a Fluorescein-linker molecule. (B) Composition of a L15 linker.

FIG. 5. Gating strategy for no-lyse no-wash procedure. Whole blood is stained with MHC multimer, anti-CD8/APC, anti-CD3/PB and CD45/CY antibody in a no-lyse no-wash procedure. For further details see text in example 39. During analysis of data the following gating strategy is used. CD45/PB antibody is used to set a trigger discriminator to allow the flow cytometer to distinguish between red blood cells and stained white blood cells. This is done during data collection by gating on CD45/PB positive cells in a CD45/PB vs. side scatter dot plot as shown in A. After data collection and during data analysis CD3 positive cells are selected by gating CD3/FITC positive cells in a CD3/FITC vs side scatter plot as shown in B.

FIG. 6. Summary flow chart ELISPOT. Summary flow chart showing measurement of antigen reactive T-cells by IFN-γ-capture in blood samples by ELISPOT. See example 31 for more detailed information.

DEFINITIONS AND ABBREVIATIONS

Figure 4:
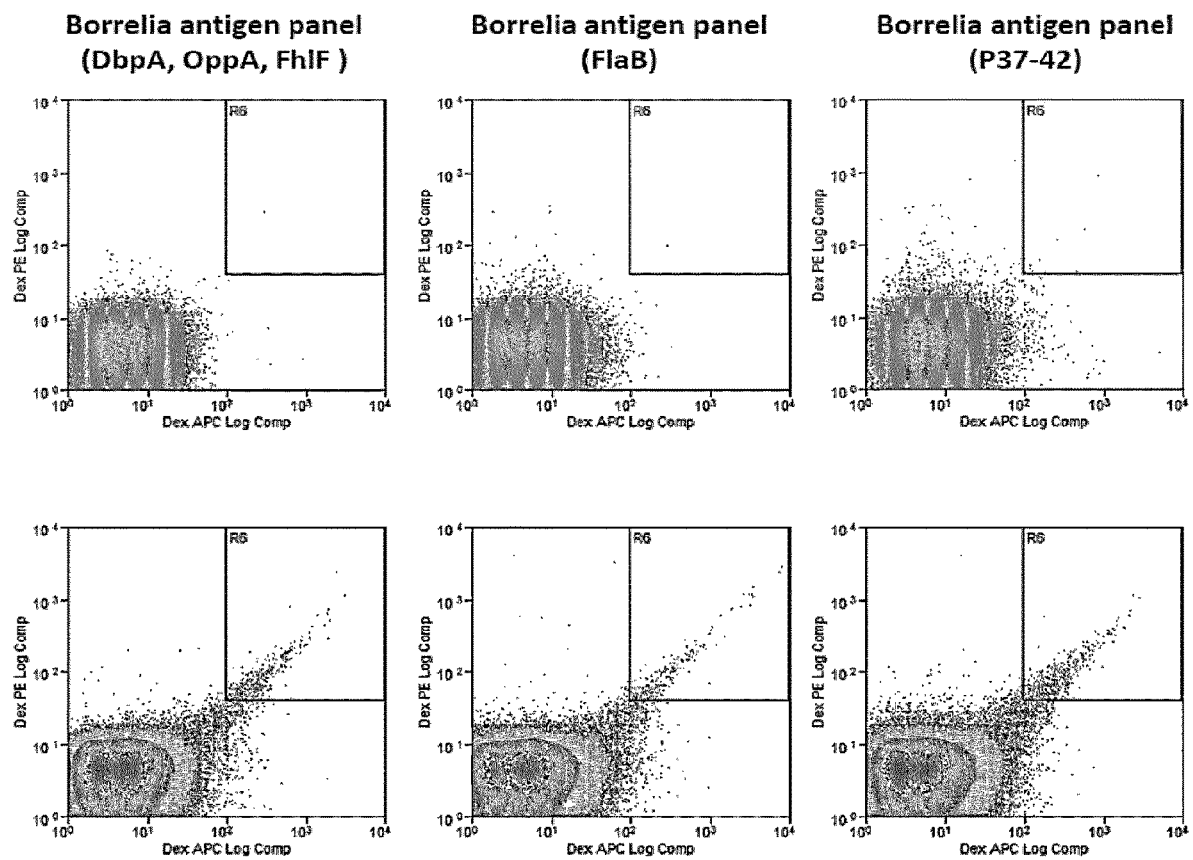
FIG. 4. Results of clinical evaluation. A) Flow cytometry results from *Borrelia* Dextramer panel analysis of a healthy seronegative control sample (top row) and sample from a neuroborreliosis patient (bottom row). Each sample was tested with three pools of *Borrelia*-specific Dextramers and positive and negative control Dextramer pool. B) Overall results of all samples tested shown as the *Borrelia*-specific T cell response measured in samples from neuroborreliosis compared to response measured in seronegative, seropositive and HLA-mismatched (MM) samples from healthy control subjects. The healthy seropositive control group include subjects with a past cleared *Borrelia* infection as well as forest workers continuously exposed to ticks. *p<0, 05, **p<0.01. NB: neuroborreliosis, SN: seronegative, SP: seropositive. C) The population of forest workers (FW) tested seropositive for *Borrelia* but diagnosed as being healthy is included separately from the subjects with a past cleared *Borrelia* infection (SP) that are constitutively exposed to ticks. See Example 26 for more details.
Figure 4B:
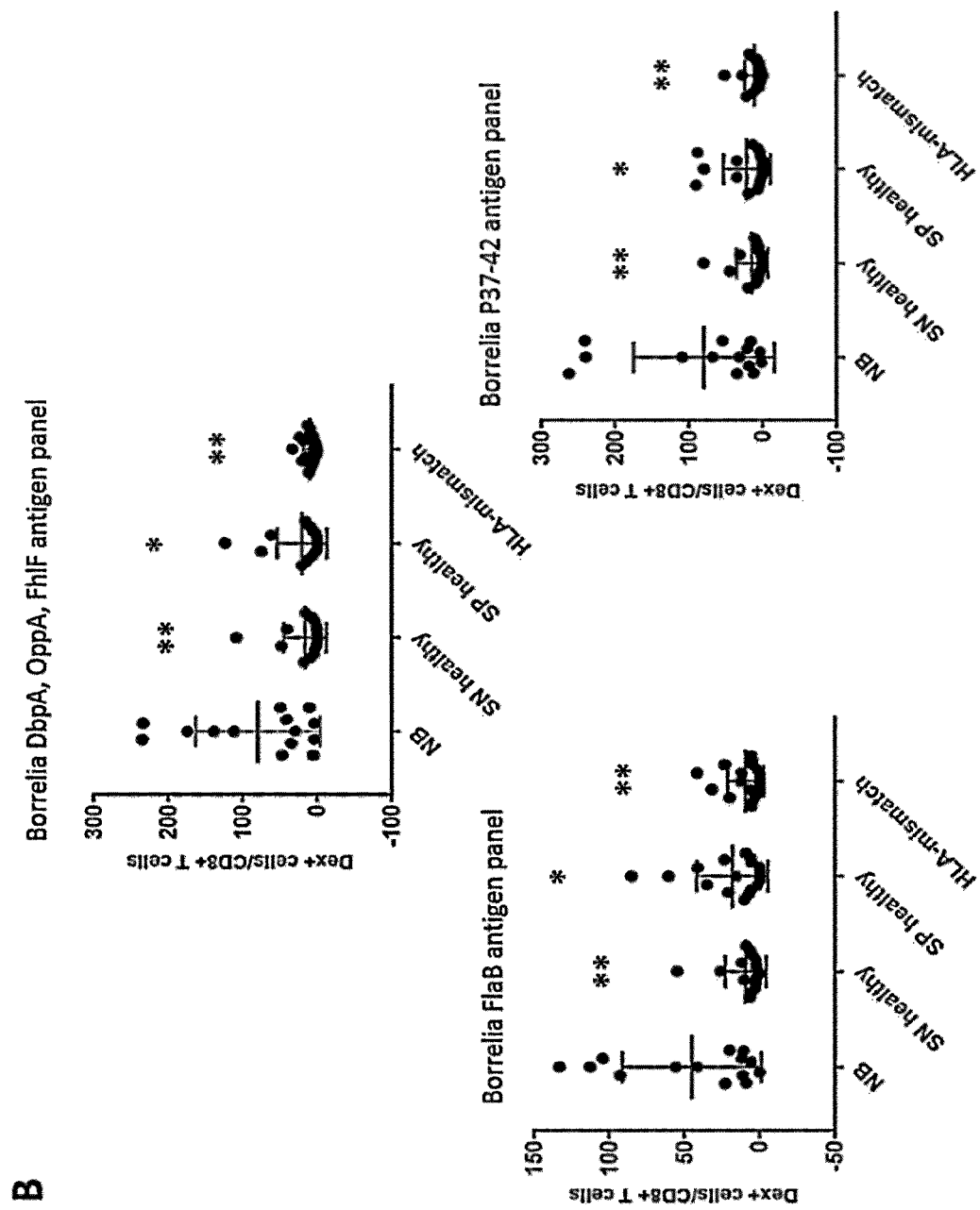
Figure 4:
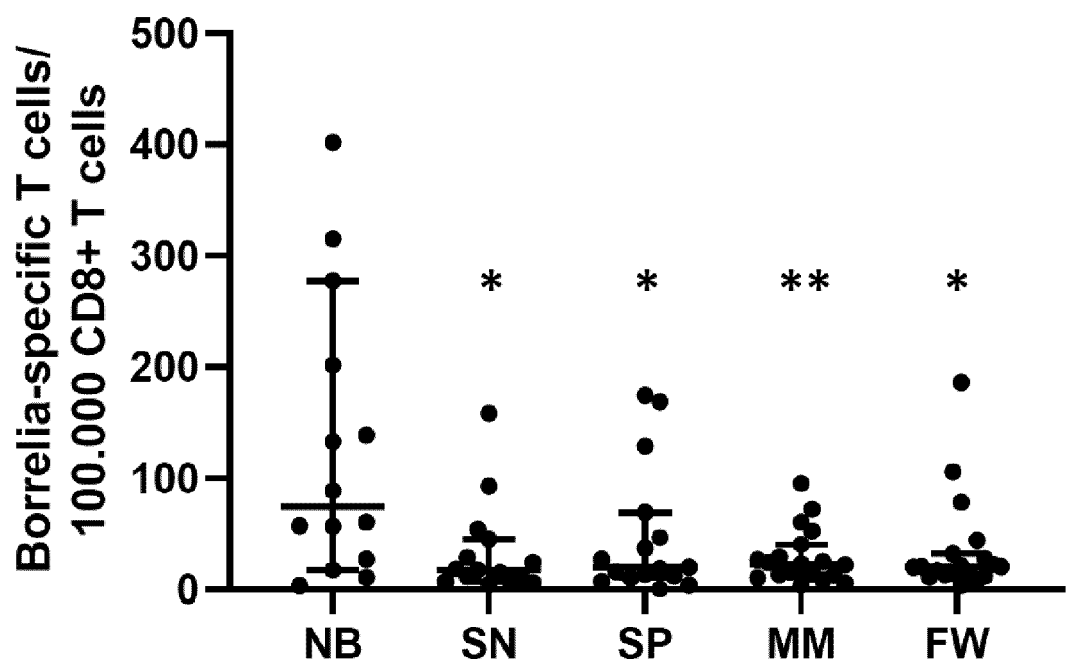

As used everywhere herein, the term "a", "an" or "the" is meant to be one or more, i. e. at least one.

"8 mers" are peptides consisting of 8 amino acids. "9 mers" are peptides consisting of 9 amino acids. "10 mers" are peptides consisting of 10 amino acids. "11 mers" are peptides consisting of 11 amino acids. "12 mers" are peptides consisting of 13 amino acids.

An "amino acid residue" can be a natural or non-natural amino acid residue linked by peptide bonds or bonds different from peptide bonds. The amino acid residues can be in D-configuration or L-configuration. An amino acid residue comprises an amino terminal part ($NH_2$) and a carboxy terminal part (COOH) separated by a central part comprising a carbon atom, or a chain of carbon atoms, at least one of which comprises at least one side chain or functional group. $NH_2$ refers to the amino group present at the amino terminal end of an amino acid or peptide, and COOH refers to the carboxy group present at the carboxy terminal end of an amino acid or peptide. The generic term amino acid comprises both natural and non-natural amino acids as are known to the skilled person. Also, non-natural amino acid residues include, but are not limited to, modified amino acid residues, L-amino acid residues, and stereoisomers of D-amino acid residues.

Adjuvant: adjuvants are drugs that have few or no pharmacological effects by themselves, but can increase the efficacy or potency of other drugs when given at the same time. In another embodiment, an adjuvant is an agent which, while not having any specific antigenic effect in itself, can stimulate the immune system, increasing the response to a vaccine.

Anchor amino acid: Anchor amino acid is used interchangeably herein with anchor residue and is an amino acid of antigenic peptide having amino acid sidechains that bind into pockets lining the peptide-binding groove of MHC molecules thereby anchoring the peptide to the MHC molecule. Anchor residues being responsible for the main anchoring of peptide to MHC molecule are called primary anchor amino acids. Amino acids contributing to the binding of antigenic peptide to MHC molecule but in a lesser extent than primary anchor amino acids are called secondary anchor amino acids.

Anchor motif: The pattern of anchor residues in an antigenic peptide binding a certain MHC molecule. Peptides binding different MHC molecules have different anchor motifs defined by the patterns of anchor residues in the peptide sequence.

Anchor residue: Anchor residue is used interchangeably herein with anchor amino acid Anchor position: The position of an anchor amino acid in antigenic peptide sequence. For MHC II the anchor positions is defined in the 9-mer core motif.

Antigen presenting cell: An antigen-presenting cell (APC) as used herein is a cell that displays foreign antigen complexed with MHC on its surface.

Antigenic peptide, Antigenic peptide P: Used interchangeably with P, binding peptide, peptide epitope P or simply epitope. Any peptide molecule that is bound or able to bind into the binding groove of an MHC molecule.

Antigenic polypeptide: A polypeptide or protein expressed in an organism that contains one or more antigenic peptides.

Aptamer: the term aptamer as used herein is defined as oligonucleic acid or peptide molecules that bind a specific target molecule. Aptamers are usually created by selecting them from a large random sequence pool, but natural aptamers also exist. Aptamers can be divided into DNA amtamers, RNA aptamers and peptide aptamers.

Avidin: Avidin as used herein is a glycoprotein found in the egg white and tissues of birds, reptiles and amphibians. It contains four identical subunits having a combined mass of 67,000-68,000 daltons. Each subunit consists of 128 amino acids and binds one molecule of biotin.

Biologically active molecule: A biologically active molecule is a molecule having itself a biological activity/effect or is able to induce a biological activity/effect when administered to a biological system. Biologically active molecules include adjuvants, immune targets (e.g. antigens), enzymes, regulators of receptor activity, receptor ligands, immune potentiators, drugs, toxins, cytotoxic molecules, co-receptors, proteins and peptides in general, sugar moieties, lipid groups, nucleic acids including siRNA, nanoparticles, small molecules.

Biotin: Biotin, as used herein, is also known as vitamin H or $B_7$. Niotin has the chemical formula $C_{10}H_{16}N_2O_3S$.

Bispecific capture molecule: Molecule that have binding specificities for at least two different antigens. The molecule can also be trispecific or multispecific.

Carrier: A carrier as used herein can be any type of molecule that is directly or indirectly associated with the MHC peptide complex. In this disclosure, a carrier will typically refer to a functionalized polymer (e.g. dextran) that is capable of reacting with MHC-peptide complexes, thus covalently attaching the MHC-peptide complex to the carrier, or that is capable of reacting with scaffold molecules (e.g. streptavidin), thus covalently attaching streptavidin to the carrier; the streptavidin then may bind MHC-peptide complexes. Carrier and scaffold are used interchangeably herein where scaffold typically refers to smaller molecules of a multimerization domain and carrier typically refers to larger molecule and/or cell like structures.

Coiled-coil polypeptide: Used interchangeably with coiled-coil peptide and coiled-coil structure. The term coiled-coil polypeptide as used herein is a structural motif in proteins, in which 2-7 alpha-helices are coiled together like the strands of a rope Dextran: the term dextran as used herein is a complex, branched polysaccharide made of many glucose molecules joined into chains of varying lengths. The straight chain consists of α1→6 glycosidic linkages between glucose molecules, while branches begin from α1→3 linkages (and in some cases, α1→2 and α1→4 linkages as well).

Folding: in vitro or in vivo folding of proteins in a tertiary structure.

Immune monitoring: Immune monitoring of the present disclosure refers to testing of immune status in the diagnosis and therapy of infectious disease. It also refers to testing of immune status before, during and after vaccination procedures.

Immune monitoring process: a series of one or more immune monitoring analysis

Label: Label herein is used interchangeable with labeling molecule. Label as described herein is an identifiable substance that is detectable in an assay and that can be attached to a molecule creating a labeled molecule. The behavior of the labeled molecule can then be studied.

Labelling: Labelling herein means attachment of a label to a molecule.

Linker molecule: Linker molecule and linker is used interchangeable herein. A linker molecule is a molecule that covalently or non-covalently connects two or more molecules, thereby creating a larger complex consisting of all molecules including the linker molecule.

Immuno profiling: Immuno profiling as used herein defines the profiling of an individual's antigen-specific T-cell repertoire Marker: Marker is used interchangeably with marker molecule herein. A marker is molecule that specifically associates covalently or non-covalently with a molecule belonging to or associated with an entity.

MHC I is used interchangeably herein with MHC class I and denotes the major histocompatibility complex class I. MHC II is used interchangeably herein with MHC class II and denotes the major histocompatibility complex class I.

MHC molecule: a MHC molecule as used everywhere herein is defined as any MHC class I molecule or MHC class II molecule as defined herein, preferably a MHC class I molecule.

A "MHC Class I molecule" as used everywhere herein is used interchangeably with MHC I molecule and is defined as a molecule which comprises 1-3 subunits, including a MHC I heavy chain, a MHC I heavy chain combined with a MHC I beta2microglobulin chain, a MHC I heavy chain combined with MHC I beta2microglobulin chain through a flexible linker, a MHC I heavy chain combined with an antigenic peptide, a MHC I heavy chain combined with an antigenic peptide through a linker, a MHC I heavy chain/MHC I beta2microglobulin dimer combined with an antigenic peptide, and a MHC I heavy chain/MHC I beta2microglobulin dimer combined with an antigenic peptide through a flexible linker to the heavy chain or beta2microglobulin. The MHC I molecule chains can be changed by substitution of single or by cohorts of native amino acids, or by inserts, or deletions to enhance or impair the functions attributed to said molecule. MHC complex: MHC complex is herein used interchangeably with MHC-peptide complex, and defines any MHC I and/or MHC molecule combined with antigenic peptide unless it is specified that the MHC complex is empty, i.e. is not complexed with antigenic peptide MHC Class I like molecules (including non-classical MHC Class I molecules) include CD1d, HLA E, HLA G, HLA F, HLA H, MIC A, MIC B, ULBP-1, ULBP-2, and ULBP-3.

A "peptide free MHC Class I molecule" is used interchangeably herein with "peptide free MHC I molecule" and as used everywhere herein is meant to be a MHC Class I molecule as defined above with no peptide. Peptide free MHC Class molecules are also called "empty" MHC molecules.

The MHC molecule may suitably be a vertebrate MHC molecule such as a human, a mouse, a rat, a porcine, a bovine or an avian MHC molecule. Such MHC complexes from different species have different names. E.g. in humans, MHC complexes are denoted HLA. The person skilled in the art will readily know the name of the MHC complexes from various species.

In general, the term "MHC molecule" is intended to include all alleles. By way of example, in humans e.g. HLA A, HLA B, HLA C, HLA D, HLA E, HLA F, HLA G, HLA H, HLA DR, HLA DQ and HLA DP alleles are of interest shall be included, and in the mouse system, H-2 alleles are of interest shall be included. Likewise, in the rat system RT1-alleles, in the porcine system SLA-alleles, in the bovine system BoLA, in the avian system e.g. chicken-B alleles, are of interest shall be included.

"MHC complexes" and "MHC constructs" are used interchangeably herein.

By the terms "MHC complexes" and "MHC multimers" as used herein are meant such complexes and multimers thereof, which are capable of performing at least one of the functions attributed to said complex or multimer. The terms include both classical and non-classical MHC complexes. The meaning of "classical" and "non-classical" in connection with MHC complexes is well known to the person skilled in the art. Non-classical MHC complexes are subgroups of MHC-like complexes. The term "MHC complex" includes MHC Class I molecules, MHC Class II molecules, as well as MHC-like molecules (both Class I and Class II), including the subgroup non-classical MHC Class I and Class molecules.

MHC multimer: The terms MHC multimer, MHC-multimer, MHCmer and MHC'mer herein are used interchangeably, to denote a complex comprising more than one MHC-peptide complexes, held together by covalent or non-covalent bonds.

Multimerization domain: A multimerization domain is a molecule, a complex of molecules, or a solid support, to which one or more MHC or MHC-peptide complexes can be attached. A multimerization domain consist of one or more carriers and/or one or more scaffolds and may also contain one or more linkers connecting carrier to scaffold, carrier to carrier, scaffold to scaffold. The multimerization domain may also contain one or more linkers that can be used for attachment of MHC complexes and/or other molecules to the multimerization domain. Multimerization domains thus include IgG, streptavidin, avidin, streptactin, micelles, cells, polymers, dextran, polysaccharides, beads and other types of solid support, and small organic molecules carrying reactive groups or carrying chemical motifs that can bind MHC complexes and other molecules; such as identified in detail herein elsewhere.

"A plurality" as used everywhere herein should be interpreted as two or more.

"One or more" as used everywhere herein is intended to include one and a plurality.

This applies i.a. to the MHC peptide complex and the binding entity. When a plurality of MHC peptide complexes is attached to the multimerization domain, such as a scaffold or a carrier molecule, the number of MHC peptide complexes need only be limited by the capacity of the multimerization domain.

Scaffold: A scaffold is typically an organic molecule carrying reactive groups, capable of reacting with reactive groups on a MHC-peptide complex. Particularly small organic molecules of cyclic structure (e.g. functionalized cycloalkanes or functionalized aromatic ring structures) are termed scaffolds. Scaffold and carrier are used interchangeably herein where scaffold typically refers to smaller molecules of a multimerization domain and carrier typically refers to larger molecule and/or cell like structures.

Staining: specific or unspecific labelling of cells by binding labelled molecules to defined proteins or other structures on the surface of cells or inside cells. The cells are either in suspension or part of a tissue. The labelled molecules can be MHC multimers, antibodies or similar molecules capable of binding specific structures on the surface of cells.

Streptavidin: Streptavidin as used herein is a tetrameric protein purified from the bacterium *Streptomyces avidinii*. Streptavidin is widely use in molecular biology through its extraordinarily strong affinity for biotin.

Vaccine: A vaccine is an antigenic preparation used to establish immunity to a disease or illness and thereby protect or cure the body from a specific disease or illness. Vaccines are either prophylactic and prevent disease or therapeutic and treat disease. Vaccines may contain more than one type of antigen and is then called a combined vaccine.

Vaccination: The introduction of vaccine into the body of human or animals for the purpose of inducing immunity.

DETAILED DESCRIPTION

The immune system is very complex. Each individual has a very large repertoire of specific T cells (on the order of $10^6$-$10^9$ different T cell specificities, differing in the identity of the T cell receptor), which again is only a small subset of the total T cell repertoire of a population of individuals. It is estimated that the Caucasian population represents a T cell diversity of $10^{10}$-$10^{12}$.

The T cell receptor recognizes MHC peptide complexes, embedded in the cell membrane. Each individual has between 3 and 6 MHC I alleles and 3 and 8 MHC II alleles. Each of these MHC alleles forms complexes with short antigenic peptides generated by proteolytic degradation and prematurely terminated protein synthesis.

Individuals of a population differ in their pattern of peptide degradation. The MHC allele diversity combined with this variation among individuals' proteolytic metabolism further enhances the variation among different individuals' immune responses. As a result, each individual has its own characteristic immune response profile, comprising its unique set of alleles and peptide combinations.

This is important when designing an antigenic peptide-based or a MHC multimer-based immune monitoring reagent or immunotherapeutic agent. If an agent is sought that should be generally applicable to the majority of individuals in a population, one should try to identify peptide epitopes and MHC alleles that are common to the majority of individuals of a population. As described elsewhere herein, such peptide epitopes can be identified through computerized search algorithms and/or experimental testing of a large set of individuals.

This approach will be advantageous in many cases, but because of the variability among immune response profiles of different individuals, is likely to be inefficient in certain individuals, because of these individuals' non-average profile. In these latter cases one may have to turn to personalized medicine. In the case of immune monitoring and immunotherapy, this may involve testing a large number of different epitopes from a given antigen, in order to find peptide epitopes that applies to the given individual.

When considering the patient population as a whole, a large fraction of the epitopes that theoretically may be generated from a given antigen, for use as a free antigenic peptide agent or to be included in a MHC I or MHC II multimer reagent, are therefore of relevance in personalized medicine. For the individual patient only a small fraction of these will be efficient; and in order to make generally applicable diagnostics, vaccines or therapeutics, even less epitopes are of relevance. Only in the case where one wants to generate a therapeutic agent or diagnostic reagent that is applicable to the majority of individuals of a population can the large majority of epitope sequences be said to be irrelevant, and those identified by computerized search algorithms and experimental testing be said to be the only epitopes of value. For the odd individual with the odd immune response these disregarded peptide epitopes may be the epitopes that provide an efficient diagnostic reagent or cures that individual from a deadly disease. In conclusion, a large fraction of the theoretical epitopes that can be generated from an antigen are of great practical value for use in personalized diagnostics, vaccines and therapeutics.

Product

In one embodiment the product of the present invention is a panel of MHC multimers comprising antigenic peptides P derived from a *Borrelia* antigenic polypeptide selected from the group consisting of OppA, DbpA, FlhF, FlaB and P37-42 as described herein elsewhere. The term "MHC multimers" will be used interchangeably with the terms MHC'mers and MHCmers, and will include any number, (larger than one) of MHC-peptide complexes, held together in a large complex by covalent or non-covalent interactions between a multimerization domain and one or more MHC-peptide complexes, and will also include the monomeric form of the MHC-peptide complex, i.e. a MHC-peptide complex that is not attached to a multimerization domain. The multimerization domain consists of one or more carriers and/or one or more scaffolds while the MHC-peptide complex consists of MHC molecule and antigenic peptide. MHC-peptide complexes may be attached to the multimerization domain through one or more linkers.

As used herein the term antigenic peptide P and antigenic peptide will be used interchangeably with the term binding peptide, binding peptide P, peptide epitope P and simply P and refers to any peptide molecule that is bound or able to bind into the binding groove of MHC proteins, especially MHC class 1.

It is an aspect of the present invention to provide a panel comprising one or more MHC multimers comprising (a-b-P)$_n$, wherein n>1,
  wherein polypeptides a and b together form a functional MHC protein capable of binding peptide P, and (a-b-P) is a MHC-peptide complex formed when peptide P binds to the functional MHC protein,
  wherein each MHC-peptide complex of a MHC multimer is associated with one or more multimerization domains;
  wherein each MHC multimer comprises an antigenic peptide P derived from a *Borrelia* antigenic polypeptide selected from the group consisting of OppA, DbpA, FlhF, FlaB and P37-42.

The antigenic peptide P in each MHC multimer may be identical or different, i.e. each MHC-peptide complex of an MHC multimer may be identical in terms of peptide P, or different in terms of peptide P.

In a preferred embodiment, the antigenic peptide P in each MHC multimer is identical, meaning that each MHC multimer comprises the same peptide P;
  i.e. each MHC-peptide complex of an MHC multimer is identical in terms of peptide P, meaning that each MHC-peptide complex of an MHC multimer comprises the same peptide P.

In one embodiment said panel comprises one MHC multimer, wherein said MHC multimer comprises an antigenic peptide P derived from a *Borrelia* antigenic polypeptide selected from the group consisting of OppA, DbpA, FlhF, FlaB and P37-42.

In one embodiment said panel comprises two or more MHC multimers, wherein each MHC multimer comprises an antigenic peptide P derived from a *Borrelia* antigenic polypeptide selected from the group consisting of OppA, DbpA, FlhF, FlaB and P37-42.

In one embodiment said panel comprises one or more MHC multimers, for example 2 or more MHC multimers, such as 3 or more MHC multimers, for example 4 or more MHC multimers, such as 5 or more MHC multimers, for example 6 or more MHC multimers, such as 7 or more MHC multimers, for example 8 or more MHC multimers such as 9 or more MHC multimers, for example 10 or more MHC multimers, for example 11 or more MHC multimers, such as 12 or more MHC multimers, for example 13 or more MHC multimers, such as 14 or more MHC multimers, for example 15 or more MHC multimers, such as 16 or more MHC multimers, for example 17 or more MHC multimers such as 18 or more MHC multimers, for example 19 or more MHC multimers, for example 20 or more MHC multimers,
  wherein each MHC multimer comprises an antigenic peptide P derived from a *Borrelia* antigenic polypeptide selected from the group consisting of OppA, DbpA, FlhF, FlaB and P37-42.

In one embodiment said panel comprises 1 MHC multimer, for example 2 MHC multimers, such as 3 MHC multimers, for example 4 MHC multimers, such as 5 MHC multimers, for example 6 MHC multimers, such as 7 MHC multimers, for example 8 MHC multimers such as 9 MHC multimers, for example 10 MHC multimers, for example 11 MHC multimers, such as 12 MHC multimers, for example 13 MHC multimers, such as 14 MHC multimers, for example 15 MHC multimers, such as 16 MHC multimers, for example 17 MHC multimers such as 18 MHC multimers, for example 19 MHC multimers, for example 20 MHC multimers,
  wherein each MHC multimer comprises an antigenic peptide P derived from a *Borrelia* antigenic polypeptide selected from the group consisting of OppA, DbpA, FlhF, FlaB and P37-42.

In one embodiment each of said one or more MHC multimers comprises an antigenic peptide P derived from a *Borrelia* antigenic polypeptide selected from the group consisting of
  i) OppA (SEQ ID NOs:1-9),
  ii) DbpA (SEQ ID NOs:10-20),
  iii) FlhF (SEQ ID NOs:21-28),
  iv) FlaB (SEQ ID NOs:29-37), and/or
  v) P37-42 (SEQ ID NOs:38-39).

In one embodiment each of said one or more MHC multimers comprises
  i) an antigenic peptide P derived from *Borrelia* antigenic polypeptide OppA, such as OppA (SEQ ID NOs:1-9);
  ii) an antigenic peptide P derived from *Borrelia* antigenic polypeptide DbpA, such as DbpA (SEQ ID NOs:10-20);
  iii) an antigenic peptide P derived from *Borrelia* antigenic polypeptide FlhF, such as FlhF (SEQ ID NOs:21-28);
  iv) an antigenic peptide P derived from *Borrelia* antigenic polypeptide FlaB, such as FlaB (SEQ ID NOs:29-37); and/or
  v) an antigenic peptide P derived from *Borrelia* antigenic polypeptide P37-42, such as P37-42 (SEQ ID NOs:38-39).

In one embodiment each of said one or more MHC multimers comprises an antigenic peptide P derived from *Borrelia* antigenic polypeptide OppA and DbpA; OppA and FlhF; OppA and FlaB; OppA and P37-42; DbpA and FlhF; DbpA and FlaB; DbpA and P37-42; FlhF and FlaB; FlhF and P37-42; or FlaB and P37-42.

In one embodiment each of said one or more MHC multimers comprises an antigenic peptide P derived from *Borrelia* antigenic polypeptide OppA, DbpA and FlhF; OppA, DbpA and FlaB; OppA, DbpA and P37-42; OppA, FlhF and FlaB; OppA, FlhF and P37-42; OppA, FlaB and P37-42; DbpA, FlhF and FlaB; DbpA, FlhF and P37-42; or FlhF, FlaB and P37-42.

In one embodiment each of said one or more MHC multimers comprises an antigenic peptide P derived from *Borrelia* antigenic polypeptide OppA, DbpA, FlhF and FlaB; OppA, DbpA, FlhF, P37-42; OppA, FlhF, FlaB and P37-42; OppA, DbpA, FlaB and P37-42; OppA, DbpA, FlhF and P37-42; DbpA, FlhF, FlaB and P37-42; or OppA, DbpA, FlhF, FlaB and P37-42.

In one embodiment said one or more antigenic peptides P are derived from a *Borrelia* antigenic polypeptide OppA selected from the group consisting of (SEQ ID NO:1), (SEQ ID NO:2), (SEQ ID NO:3), (SEQ ID NO:4), (SEQ ID NO:5), (SEQ ID NO:6), (SEQ ID NO:7), (SEQ ID NO:8) and (SEQ ID NO:9).

In one embodiment said one or more antigenic peptides P are derived from a *Borrelia* antigenic polypeptide DbpA selected from the group consisting of (SEQ ID NO:10), (SEQ ID NO:11), (SEQ ID NO:12), (SEQ ID NO:13), (SEQ ID NO:14), (SEQ ID NO:15), (SEQ ID NO:16), (SEQ ID NO:17), (SEQ ID NO:18), (SEQ ID NO:19), and (SEQ ID NO:20).

In one embodiment said one or more antigenic peptides P are derived from a *Borrelia* antigenic polypeptide FlhF selected from the group consisting of (SEQ ID NO:21), (SEQ ID NO:22), (SEQ ID NO:23), (SEQ ID NO:24), (SEQ ID NO:25), (SEQ ID NO:26), (SEQ ID NO:27), and (SEQ ID NO:28).

In one embodiment said one or more antigenic peptides P are derived from a *Borrelia* antigenic polypeptide FlaB selected from the group consisting of (SEQ ID NO:29), (SEQ ID NO:30), (SEQ ID NO:31), (SEQ ID NO:32), (SEQ ID NO:33), (SEQ ID NO:34), (SEQ ID NO:35), (SEQ ID NO:36), and (SEQ ID NO:37).

In one embodiment said one or more antigenic peptides P are derived from a *Borrelia* antigenic polypeptide P37-42 selected from the group consisting of (SEQ ID NO:38) and (SEQ ID NO:39).

In one embodiment there is provided a panel comprising one or more MHC multimers, wherein each of said one or more MHC multimers comprises an antigenic peptide P derived from a *Borrelia* antigenic polypeptide selected from the group consisting of OppA, DbpA, FlhF, FlaB and P37-42;
  wherein one or more of said one or more MHC multimers comprises an antigenic peptide P derived from *Borrelia* antigenic polypeptide OppA; and/or
  wherein one or more of said one or more MHC multimers comprises an antigenic peptide P derived from *Borrelia* antigenic polypeptide DbpA; and/or
  wherein one or more of said one or more MHC multimers comprises an antigenic peptide P derived from *Borrelia* antigenic polypeptide FlhF; and/or
  wherein one or more of said one or more MHC multimers comprises an antigenic peptide P derived from *Borrelia* antigenic polypeptide FlaB; and/or
  wherein one or more of said one or more MHC multimers comprises an antigenic peptide P derived from *Borrelia* antigenic polypeptide P37-42.

In one embodiment there is provided a panel comprising one or more MHC multimers, wherein each of said one or more MHC multimers comprises an antigenic peptide P derived from a *Borrelia* antigenic polypeptide selected from the group consisting of OppA, DbpA, FlhF, FlaB and P37-42.

In one embodiment said one or more antigenic peptides P are derived from a *Borrelia* antigenic polypeptide selected from the group consisting of OppA, DbpA, FlhF, FlaB and P37-42 each derived from a *Borrelia* species or subspecies selected from the group consisting of: *Borrelia anserina, Borrelia barbouri, Borrelia afzelii, Borrelia afzelii* ACA-1, *Borrelia afzelii* K78, *Borrelia afzelii* PKo, *Borrelia andersonii, Borrelia bissettii, Borrelia burgdorferi, Borrelia burgdorferi* 118a, *Borrelia burgdorferi* 156a, *Borrelia burgdorferi* 29805, *Borrelia burgdorferi* 64b, *Borrelia burgdorferi* 72a, *Borrelia burgdorferi* 80a, *Borrelia burgdorferi* 94a, *Borrelia burgdorferi* B31, *Borrelia burgdorferi* Bol26, *Borrelia burgdorferi* CA-11.2a, *Borrelia burgdorferi* WI91-23, *Borrelia burgdorferi* ZS7, *Borrelia californiensis, Borrelia garini, Borrelia garini* PBi, *Borrelia garini* PBr, *Borrelia genomosp.* 1, *Borrelia genomosp.* 2, *Borrelia japonica, Borrelia lusitaniae, Borrelia spielmanii, Borrelia spielmanii* A14S, *Borrelia tanukii, Borrelia turdi, Borrelia valaisiana, Borrelia valaisiana* VS116, Candidatus *Borrelia texasensis, Borrelia* sp. AA4Pool, *Borrelia* sp. AI-1, *Borrelia* sp. B31, *Borrelia* sp. BC-1, *Borrelia* sp. CA1133, *Borrelia* sp. CA1176, *Borrelia* sp. CA128, *Borrelia* sp. CA13, *Borrelia* sp. CA134, *Borrelia* sp. CA142, *Borrelia* sp. CA20, *Borrelia* sp. CA22, *Borrelia* sp. CA27, *Borrelia* sp. CA28, *Borrelia* sp. CA29, *Borrelia* sp. CA31, *Borrelia* sp. CA33, *Borrelia* sp. CA370, *Borrelia* sp. CA372, *Borrelia* sp. CA378, *Borrelia* sp. CA388, *Borrelia* sp. CA393, *Borrelia* sp. CA394, *Borrelia* sp. CA395, *Borrelia* sp. CA399, *Borrelia* sp. CA400, *Borrelia* sp. CA401, *Borrelia* sp. CA402, *Borrelia* sp. CA404, *Borrelia* sp. CA411, *Borrelia* sp. CA426, *Borrelia* sp. CA443, *Borrelia* sp. CA446, *Borrelia* sp. CA448, *Borrelia* sp. CA462, *Borrelia* sp. CA468, *Borrelia* sp. CA502, *Borrelia* sp. CA504, *Borrelia* sp. CA507, *Borrelia* sp. CA547, *Borrelia* sp. CA552, *Borrelia* sp. CA8, *Borrelia* sp. D22, *Borrelia* sp. D35, *Borrelia* sp. FD-1, *Borrelia* sp. FL18, *Borrelia* sp. FL27, *Borrelia* sp. FL35, *Borrelia* sp. FL42, *Borrelia* sp. HN6, *Borrelia* sp. HN7, *Borrelia* sp. HN8, *Borrelia* sp. HNM13, *Borrelia* sp. HNM14, *Borrelia* sp. HNM19, *Borrelia* sp. IA1, *Borrelia* sp. Ir-3519, *Borrelia* sp. Ir-4721, *Borrelia* sp. Ir-4812, *Borrelia* sp. Ir-5215, *Borrelia* sp. LV5, *Borrelia* sp. MI-2, *Borrelia* sp. MI-5, *Borrelia* sp. MI-6, *Borrelia* sp. MI-8, *Borrelia* sp. MI-9, *Borrelia* sp. MOD-1, *Borrelia* sp. MOD-5, *Borrelia* sp. MOK-3a, *Borrelia* sp. MOS-1b, *Borrelia* sp. NE49, *Borrelia* sp. NE581, *Borrelia* sp. PHaP, *Borrelia* sp. PSigII, *Borrelia* sp. SCGT-10, *Borrelia* sp. SCGT-8a, *Borrelia* sp. SCI-2, *Borrelia* sp. SCW-30h, *Borrelia* sp. SI-1, *Borrelia* sp. SI-10, *Borrelia* sp. SM-1, *Borrelia* sp. SV1, *Borrelia* sp. W97F51, *Borrelia* sp. Z41293, *Borrelia* sp. Z41493, *Borrelia coriaceae, Borrelia crocidurae, Borrelia duttonii, Borrelia duttonii* Ly, *Borrelia hermsii, Borrelia hermsii* DAH, *Borrelia hispanica, Borrelia lonestari, Borrelia miyamotoi, Borrelia parkeri, Borrelia persica, Borrelia recurrentis, Borrelia recurrentis* A1, *Borrelia sinica, Borrelia theileri, Borrelia turcica, Borrelia turicatae, Borrelia turicatae* 91E135, *Borrelia* sp., *Borrelia* sp. 'Lake Gaillard', *Borrelia* sp. 000133, *Borrelia* sp. 010298, *Borrelia* sp. 10MT, *Borrelia* sp. 5145, *Borrelia* sp. 57Nsk, *Borrelia* sp. 5MT, *Borrelia* sp. 6T04-2, *Borrelia* sp. BR, *Borrelia* sp. BR 2007, *Borrelia* sp. C5-N52, *Borrelia* sp. CB-A1, *Borrelia* sp. CB-A11, *Borrelia* sp. CB-A3, *Borrelia* sp. EFL-SO100110, *Borrelia* sp. IK/23, *Borrelia* sp. IM/16, *Borrelia* sp. IM/19, *Borrelia* sp. KR1, *Borrelia* sp. KR3, *Borrelia* sp. LB-2001, *Borrelia* sp. LB-M56, *Borrelia* sp. LB-W100, *Borrelia* sp. MK-N61, *Borrelia* sp. NR-N8, *Borrelia* sp. OkME1, *Borrelia* sp. PAnz, *Borrelia* sp. PJes, *Borrelia* sp. PMai, *Borrelia* sp. PMew, *Borrelia* sp. R57, *Borrelia* sp. strain Spain, *Borrelia* sp. TA1, *Borrelia* sp. TM, *Borrelia* sp. TM1 and *Borrelia* sp. TM2.

A panel comprising one or more MHC multimers as disclosed herein is meant to potentially also include other components, such as one or more negative control MHC multimers and/or positive control MHC multimers.

Hence in one embodiment there is provided a panel comprising one or more MHC multimers as defined herein, further comprising one or more negative control MHC multimers.

A negative control MHC multimer in one embodiment is a MHC multimer comprising a negative control peptide P. Said negative control peptide P is in one embodiment selected from the group consisting of a nonsense peptide, a nonsense chemically modified peptide, a naturally occurring peptide different from the peptide used for analysis of specific T cells in the sample, a peptide which is not derived from a *Borrelia* antigenic polypeptide, and a peptide which is not derived from a *Borrelia* antigenic polypeptide selected from the group consisting of OppA, DbpA, FlhF, FlaB and P37-42.

In one embodiment the negative control MHC multimer is an empty MHC multimer. In one embodiment a negative control MHC multimer comprises peptide ALIAPVHAV (SEQ ID NO: 5913).

In another embodiment there is provided a panel comprising one or more MHC multimers as defined herein, further comprising one or more positive control MHC multimers, such as a MHC multimer comprising a positive control peptide P.

In one embodiment a positive control MHC multimer comprises a peptide selected from the group consisting of NLVPMVATV (SEQ ID NO: 5914), GLCTLVAML (SEQ ID NO: 5915) and GILGFVFTL (SEQ ID NO: 5916).

Furthermore, the present disclosure relates to compositions comprising a panel comprising one or more MHC multimers as disclosed herein. In one embodiment said composition comprises the MHC multimers in a solubilising medium, and/or immobilised onto a solid or semi-solid support.

It is also an aspect of the present invention to provide a panel comprising one or more pools of MHC multimers comprising (a-b-P)$_n$, wherein n>1, wherein polypeptides a and b together form a functional MHC protein capable of binding peptide P, and (a-b-P) is a MHC-peptide complex formed when peptide P binds to the functional MHC protein, wherein each MHC-peptide complex of a MHC multimer is associated with one or more multimerization domains;

wherein each pool comprises one or more MHC multimers each comprising an antigenic peptide P derived from a *Borrelia* antigenic polypeptide selected from the group consisting of OppA, DbpA, FlhF, FlaB and P37-42.

Again, for the pools as well as the panel of the present disclosure, the antigenic peptide P in each MHC multimer may be identical or different, i.e. each MHC-peptide complex of an MHC multimer may be identical in terms of peptide P, or different in terms of peptide P.

In a preferred embodiment, the antigenic peptide P in each MHC multimer is identical, meaning that each MHC multimer comprises the same peptide P;

i.e. each MHC-peptide complex of an MHC multimer is identical in terms of peptide P, meaning that each MHC-peptide complex of an MHC multimer comprises the same peptide P.

In one embodiment said panel comprises one or more pools of MHC multimers, such as 1 pool of MHC multimers, for example 2 pools of MHC multimers, such as 3 pools of MHC multimers, for example 4 pools of MHC multimers, such as 5 pools of MHC multimers, for example 6 pools of MHC multimers, such as 7 pools of MHC multimers, for example 8 pools of MHC multimers such as 9 pools of MHC multimers, for example 10 pools of MHC multimers, wherein each pool comprises one or more MHC multimers, such as 1 MHC multimer, for example 2 MHC multimers, such as 3 MHC multimers, for example 4 MHC multimers, such as 5 MHC multimers, for example 6 MHC multimers, such as 7 MHC multimers, for example 8 MHC multimers such as 9 MHC multimers, for example 10 MHC multimers, for example 11 MHC multimers, such as 12 MHC multimers, for example 13 MHC multimers, such as 14 MHC multimers, for example 15 MHC multimers, such as 16 MHC multimers, for example 17 MHC multimers such as 18 MHC multimers, for example 19 MHC multimers, for example 20 MHC multimers, wherein each MHC multimer comprises an antigenic peptide P derived from a *Borrelia* antigenic polypeptide selected from the group consisting of OppA, DbpA, FlhF, FlaB and P37-42.

In one embodiment said panel comprises one or more pools of MHC multimers, wherein each pool comprises two or more MHC multimers each comprising an antigenic peptide P derived from a *Borrelia* antigenic polypeptide selected from the group consisting of OppA, DbpA, FlhF, FlaB and P37-42.

In one embodiment said panel comprises two or more pools of MHC multimers, wherein each pool comprises one or more MHC multimers each comprising an antigenic peptide P derived from a *Borrelia* antigenic polypeptide selected from the group consisting of OppA, DbpA, FlhF, FlaB and P37-42.

In one embodiment said panel comprises two or more pools of MHC multimers, wherein each pool comprises two or more MHC multimers each comprising an antigenic peptide P derived from a *Borrelia* antigenic polypeptide selected from the group consisting of OppA, DbpA, FlhF, FlaB and P37-42.

In one embodiment said panel comprises one pool of MHC multimers, wherein said pool comprises one MHC multimer comprising an antigenic peptide P derived from a *Borrelia* antigenic polypeptide selected from the group consisting of OppA, DbpA, FlhF, FlaB and P37-42.

In one embodiment said panel comprises one pool of MHC multimers, wherein said pool comprises two or more MHC multimers each comprising an antigenic peptide P derived from a *Borrelia* antigenic polypeptide selected from the group consisting of OppA, DbpA, FlhF, FlaB and P37-42.

In one embodiment said panel comprises two or more pools of MHC multimers, wherein each pool comprises one or more MHC multimers each comprising an antigenic peptide P derived from a *Borrelia* antigenic polypeptide selected from the group consisting of i) OppA (SEQ ID NOs:1-9),
ii) DbpA (SEQ ID NOs:10-20),
iii) FlhF (SEQ ID NOs:21-28),
iv) FlaB (SEQ ID NOs:29-37), and/or
v) P37-42 (SEQ ID NOs:38-39).

In one embodiment said panel comprises two or more pools of MHC multimers, wherein each pool comprises one or more MHC multimers each comprising i) an antigenic peptide P derived from *Borrelia* antigenic polypeptide OppA, such as OppA (SEQ ID NOs:1-9);
ii) an antigenic peptide P derived from *Borrelia* antigenic polypeptide DbpA, such as DbpA (SEQ ID NOs:10-20);
iii) an antigenic peptide P derived from *Borrelia* antigenic polypeptide FlhF, such as FlhF (SEQ ID NOs:21-28);
iv) an antigenic peptide P derived from *Borrelia* antigenic polypeptide FlaB, such as FlaB (SEQ ID NOs:29-37); and/or
v) an antigenic peptide P derived from *Borrelia* antigenic polypeptide P37-42, such as P37-42 (SEQ ID NOs:38-39).

In one embodiment said panel comprises two or more pools of MHC multimers, wherein each pool comprises one or more MHC multimers each comprising an antigenic peptide P derived from a *Borrelia* antigenic polypeptide selected from the group consisting of OppA, DbpA, FlhF, FlaB and P37-42, wherein one of said two or more pools comprises an MHC multimer comprising an antigenic peptide P derived from a *Borrelia* antigenic polypeptide selected from the group consisting of OppA, DbpA, FlhF, FlaB and P37-42; and/or wherein one of said two or more pools comprises 2 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 3 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 4 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 5 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 6 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 7 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 8 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 9 MHC multimers each comprising an antigenic peptide P derived from a *Borrelia* antigenic polypeptide selected from the group consisting of OppA, DbpA, FlhF, FlaB and P37-42; and/or wherein one of said two or more pools comprises 10 MHC multimers each comprising an antigenic peptide P derived from a *Borrelia* antigenic polypeptide selected from the group consisting of OppA, DbpA, FlhF, FlaB and P37-42.

In one embodiment said panel comprises two or more pools of MHC multimers, wherein each pool comprises one or more MHC multimers each comprising an antigenic peptide, wherein the antigenic peptide P in each of said one or more MHC multimers in each pool may be identical or different.

In one embodiment said panel comprises two or more pools of MHC multimers, wherein each pool comprises one or more MHC multimers each comprising an antigenic peptide P derived from a *Borrelia* antigenic polypeptide selected from the group consisting of OppA, DbpA, FlhF, FlaB and P37-42, wherein one of said two or more pools comprises one or more MHC multimers comprising an antigenic peptide P derived from a *Borrelia* antigenic polypeptide selected from the group consisting of OppA, DbpA, FlhF, FlaB and P37-42; and/or wherein one of said two or more pools comprises 2 or more MHC multimers each comprising an antigenic peptide P derived from *Borrelia* antigenic polypeptide selected from the group consisting of: OppA and DbpA; OppA and FlhF; OppA and FlaB; OppA and P37-42; DbpA and FlhF; DbpA and FlaB; DbpA and P37-42; FlhF and FlaB; FlhF and P37-42; FlaB and P37-42; and/or wherein one of said two or more pools comprises 3 or more MHC multimers each comprising an antigenic peptide P derived from *Borrelia* antigenic polypeptide selected from the group consisting of: OppA, DbpA and FlhF; OppA, DbpA and FlaB; OppA, DbpA and P37-42; OppA, FlhF and FlaB; OppA, FlhF and P37-42; OppA, FlaB and P37-42; DbpA, FlhF and FlaB; DbpA, FlhF and P37-42; FlhF, FlaB and P37-42; and/or wherein one of said two or more pools comprises 4 or more MHC multimers each comprising an antigenic peptide P derived from *Borrelia* antigenic polypeptide selected from the group consisting of: OppA, DbpA, FlhF and FlaB; OppA, DbpA, FlhF, P37-42; OppA, FlhF, FlaB and P37-42; OppA, DbpA, FlaB and P37-42; OppA, DbpA, FlhF and P37-42; DbpA, FlhF, FlaB and P37-42; and/or wherein one of said two or more pools comprises 5 or more MHC multimers each comprising an antigenic peptide P derived from *Borrelia* antigenic polypeptide each derived from *Borrelia* antigenic polypeptide selected from the group consisting of OppA, DbpA, FlhF, FlaB and P37-42.

A panel comprising one or more pools of MHC multimers, wherein each pool comprises one or more MHC multimers, as disclosed herein, is meant to potentially also include other components, such as one or more pools of negative control MHC multimers and/or one or more pools of positive control MHC multimers.

Hence in one embodiment there is provided a panel comprising one or more pools of MHC multimers, wherein each pool comprises one or more MHC multimers each comprising an antigenic peptide P derived from a *Borrelia* antigenic polypeptide selected from the group consisting of OppA, DbpA, FlhF, FlaB and P37-42, further comprising a pool comprising one or more negative control MHC multimers.

A negative control MHC multimer in one embodiment is a MHC multimer comprising a negative control peptide P. Said negative control peptide P is in one embodiment selected from the group consisting of a nonsense peptide, a nonsense chemically modified peptide, a naturally occurring peptide different from the peptide used for analysis of specific T cells in the sample, a peptide which is not derived from a *Borrelia* antigenic polypeptide, and a peptide which is not derived from a *Borrelia* antigenic polypeptide selected from the group consisting of OppA, DbpA, FlhF, FlaB and P37-42.

In one embodiment a negative control MHC multimer is an empty MHC multimer. In one embodiment a negative control MHC multimer comprises peptide ALIAPVHAV (SEQ ID NO: 5913).

In another embodiment there is provided a panel comprising one or more pools of MHC multimers, wherein each pool comprises one or more MHC multimers each comprising an antigenic peptide P derived from a *Borrelia* antigenic polypeptide selected from the group consisting of OppA, DbpA, FlhF, FlaB and P37-42, further comprising a pool comprising one or more positive control MHC multimers.

In one embodiment a positive control MHC multimer comprises a peptide selected from the group consisting of NLVPMVATV (SEQ ID NO: 5914), GLCTLVAML (SEQ ID NO: 5915) and GILGFVFTL (SEQ ID NO: 5916).

In a preferred embodiment the individual antigenic peptides P of each MHC-peptide complex of said MHC multimer in said panel comprising one or more pools of MHC multimers, are identical.

In one embodiment the individual antigenic peptides P of each MHC-peptide complex of said MHC multimer in said panel comprising one or more pools of MHC multimers, are different.

Furthermore, the present disclosure relates to compositions comprising a panel comprising one or more pools of MHC multimers as disclosed herein. In one embodiment said composition comprises the MHC multimers in a solubilising medium, and/or immobilised onto a solid or semi-solid support.

In the following the design and generation of antigenic peptides and the different components of MHC multimers are described.

Design and Generation of Antigenic Peptides

Antigenic peptides of the present disclosure may be used in the disclosed processes either as part of MHC multimers or used themselves as a product. Antigenic peptide products will later in the process they are used for, bind MHC molecules and thereby generate MHC multimers, e.g. when used as a vaccine the antigenic peptides may bind MHC molecules on cells inside the body or when used for an immune monitoring process antigenic peptides binds MHC molecules present in the sample they are applied to. The features of and principles for design and generation of antigenic peptides according to the present disclosure will be described in more detail in the following.

MHC class 1 protein typically binds octa-, nona-, deca- or ondecamer (8-, 9-, 10,- 11-mer) peptides in their peptide binding groove, in some instances up to 12mer peptides. The individual MHC class 1 alleles have individual preferences for the peptide length within the given range. MHC class 2 proteins typically bind peptides with a total length of 13-18 amino acids, comprising a 9'-mer core motif containing the important amino acid anchor residues. However the total length is not strictly defined, as opposed to most MHC class 1 molecules.

For some of the MHC alleles the optimal peptide length and the preferences for specific amino acid residues in the so called anchor positions are known.

To identify high-affinity binding peptides derived from a specific protein for a given MHC allele it is necessary to systematically work through the amino acid sequence of the protein to identify the putative high-affinity binding peptides. Although a given peptide is a binder it is not necessarily a functional T-cell epitope. Functionality needs to be confirmed by a functional analysis e.g. ELISPOT, CTL killing assay or flow cytometry assay as described elsewhere herein.

The antigenic peptides can in one embodiment be generated by computational prediction e.g. using NetMHC (www.cbs.dtu.dk/services/NetMHC/) or by selection of specific 8, 9, 10, 11, 12-mer amino acid sequences. The binding affinity of the peptides can for some MHC molecules be predicted in databases such as www.syfpeithi.de; http://www-bimas.cit.nih.gov/molbio/hla_bind/; www.cbs.dtu.dk/services/NetMHC/; and www.cbs.dtu.dk/services/NetMHCII/.

Design of Binding Peptides, P

The first step in the design of binding peptides P is obtaining the amino acid sequence of the protein or antigenic polypeptide of interest. For the purposes of the present disclosure, the amino acid sequences of *Borrelia* proteins OppA, DbpA, FlhF, FlaB and P37-42, each from a number of *Borrelia* species and strains, were retrieved from the NCBI protein database (http://www.ncbi.nlm.nih.gov), as described in Examples 16-21.

In many cases the amino acid sequence of the protein from which antigenic peptides have to be identified from are known. However, when only the genomic DNA sequences are known, i.e. the reading frame and direction of transcription of the genes is unknown, the DNA sequence needs to be translated in all three reading frames in both directions leading to a total of six amino acid sequences for a given genome. From these amino acid sequences binding peptides can then be identified as described below. In organisms having intron/exon gene structure the present approach must be modified accordingly, to identify peptide sequence motifs that are derived by combination of amino acid sequences derived partly from two separate introns. cDNA sequences can be translated into the actual amino acid sequences to allow peptide identification. In cases where the protein sequence is known, these can directly be used to predict peptide epitopes.

Binding peptide sequences can be predicted from any protein sequence by either a total approach, generating binding peptide sequences for potentially any MHC allele, or by a directed approach, identifying a subset of binding peptides with certain preferred characteristics such as affinity for MHC protein, specificity for MHC protein, likelihood of being formed by proteolysis in the cell, and other important characteristics.

Design of MHC Class 1 Binding Peptide Sequence

Many parameters influence the design of the individual binding peptide, P, as well as the choice of the set of binding peptides to be used in a particular application. Important characteristics of the MHC-peptide complex are physical and chemical (e.g. proteolytic) stability. The relevance of these parameters must be considered for the production of the antigenic peptides, P, the MHC-peptide complexes and the MHC multimers, as well as for their use in a given application. As an example, the stability of the MHC-peptide complex in assay buffer (e.g. PBS), in blood, or in the body can be very important for a particular application.

In the interaction of the MHC-peptide complex with the TCR, a number of additional characteristics must be considered, including binding affinity and specificity for the TCR, degree of cross-talk, undesired binding or interaction with other TCRs. Finally, a number of parameters must be considered for the interaction of MHC-peptide complexes, MHC multimers or antigenic peptides with the sample or individual it is being applied to. These include immunogenicity, allergenicity, as well as side effects resulting from un-desired interaction with "wrong" T cells, including cross-talk with e.g. autoimmune diseases and un-desired interaction with other cells than antigen-specific T cells.

For some applications, e.g. immuno-profiling of an individual's immune response focused on one antigen, it is preferred that all possible binding peptides of that antigen are included in the application (i.e. the "total approach" for the design of binding peptides described below). For other applications, e.g. vaccines it may be adequate to include a few or just one binding peptide for each of the HLA-alleles included in the application (i.e. the "directed approach" whereby only the most potent binding peptides can be included). Personalized diagnostics, therapeutics and vaccines will often fall in-between these two extremes, as it will only be necessary to include a few or just one binding peptide in e.g. a vaccine targeting a given individual, but the specific binding peptide may have to be picked from binding peptides designed by the total approach, and identified through the use of immuno-profiling studies involving all possible binding peptides. The principles of immuno-profiling is described elsewhere herein.

a) Total Approach

The MHC class 1 binding peptide, P, prediction is done as follows using the total approach. The actual protein sequence is split up into 8-, 9-, 10-, and 11-mer peptide sequences. This is performed by starting at amino acid position 1 identifying the first 8-mer; then move the start position by one amino acid identifying the second 8-mer; then move the start position by one amino acid, identifying the third 8-mer. This procedure continues by moving start position by one amino acid for each round of peptide identification. Generated peptides will be amino acid position 1-8, 2-9, 3-10 etc. This procedure can be carried out manually or by means of a software program (such as disclosed in FIG. 2 of WO 2009/106073). This procedure is then repeated in an identical fashion for 9-, 10, 11- and 12-mers, respectively.

b) Directed Approach

The directed approach identifies a preferred subset of binding peptides, P, from the binding peptides generated in the total approach. This preferred subset is of particularly value in a given context. One way to select subsets of antigenic peptides (P) is to use consensus sequences to choose a set of relevant binding peptides able to bind the individual MHC allele and that will suit the "average" individual. Such consensus sequences often solely consider the affinity of the binding peptide for the MHC protein; in other words, a subset of binding peptides is identified where the designed binding peptides have a high probability of forming stable MHC-peptide complexes, but where it is uncertain whether this MHC-peptide complex is of high relevance in a population, and more uncertain whether this MHC-peptide complex is of high relevance in a given individual.

For class I MHC-alleles, the consensus sequence for a binding peptide is generally given by the formula X1-X2-X3-X4- . . . -Xn, where n equals 8, 9, 10, or 11, and where X represents one of the twenty naturally occurring amino acids, optionally modified as described elsewhere in this application. X1-Xn can be further defined. Thus certain positions in the consensus sequence are more likely to contribute to binding to a given MHC molecule than others.

Antigenic peptide-binding by MHC I is accomplished by interaction of specific amino acid side chains of the antigenic peptide with discrete pockets within the peptide-binding groove of the MHC molecule. The peptide-binding groove is formed by the α1 and α2 domains of the MHC I heavy chain and contains six pockets denoted A, B, C, D, E, F. For human HLA molecules the main binding energy associating antigenic peptide to MHC I is provided by interaction of amino acids in position 2 and at the c-terminus of the antigenic peptide with the B and F binding pockets of the MHC I molecule. The amino acids of the antigenic peptide being responsible for the main anchoring of the peptide to the MHC molecule are in the following called primary anchor amino acids and the motif they form for primary anchor motif. Other amino acid side chains of an antigenic peptide may also contribute to the anchoring of the antigenic peptide to the MHC molecule but to a lesser extent. Such amino acids are often referred to as secondary anchor amino acids and form a secondary anchor motif.

Different HLA alleles have different amino acids lining the various pockets of the peptide-binding groove enabling the various alleles to bind unique repertoires of antigenic peptides with specific anchor amino acid motifs. Thus for a selected consensus sequence certain positions are the so-called anchor positions and the selection of useful amino acids for these positions is limited to those able to fit into the corresponding binding pockets in the HLA molecule. For example for peptides binding HLA-A*02, X2 and X9 are primary anchor positions docking into the B and F pocket of the HLA molecule respectively, and useful amino acids at these two positions in the binding peptide are preferable limited to leucine or methionine for X2 and to valine or leucine at position X9. In contrast the primary anchor positions of peptides binding HLA-B*08 are X3, X5 and X9 and the corresponding preferred amino acids at these positions are lysine at position X3, lysine or arginine at position X5 and leucine at position X9.

However, the different HLA alleles can be grouped into clusters or supertypes where the alleles of the supertype share peptide-binding pocket similarities in that they are able to recognize the same type of antigenic peptide primary anchor motif. Therefore antigenic peptides can be selected on their ability to bind a given HLA molecule or a given HLA supertype on the basis of their amino acid sequence, e.g. the identity of the primary anchor motif.

Antigenic peptide primary anchor motifs of special interest of the present disclosure are listed in the below table 1.

TABLE I

HLA I supertype families and their antigenic peptide anchor motifs. Examples of useful amino acids binding in pocket B and pocket F are shown as one letter code.

| | | Anchor motif | | | |
|---|---|---|---|---|---|
| Supertype | B pocket specificity | Example aa B pocket | F pocket specificity | Example aa F pocket | Example of HLA allele's |
| A01 | Small and aliphatic | A,T, S, V, L, I, M, Q | Aromatic and large hydrophobic | F, W, Y, L, I, M | A*0101, A*2601, A*2602, A*2603, A*3002, A*3003, A*3004, A*3201 |
| A01/A03 | Small and aliphatic | A,T, S, V, L, I, M, Q | Aromatic and basic | Y, R, K | A*3001, A*3201, A*7401 |
| A01/A24 | Small, aliphatic and aromatic | A, S, T, V, L, I, M, Q, F, W, Y | Aromatic and large hydrophobic | F, W, Y, L, I, M | A*2902 |
| A02 | Small and aliphatic | A, T, S, V, L, I, M, Q | Aliphatic and small hydrophobic | L, I, V, M, Q, A | A*0201, A*0202, A*0203, A*0204, A*0205, A*0206, A*0207, A*0214, A*0217, A*6802, A*6901 |
| A03 | Small and aliphatic | A, T, S, V, L, I, M, Q | Basic | R, H, K | A*0301, A*1101, A*3101, A*3301, A*3303, A*6601, A*6801, A*7401 |
| A24 | Aromatic and aliphatic | F, W, Y, L, I, V, M, Q | Aromatic, aliphatic and hydrophbic | F, W, Y, L, I, V, M, Q, A | A*2301, A*2402 |
| B07 | Proline | P | Aromatic, aliphatic and hydrophbic | F, W, Y, L, I, V, M, Q, A | B*0702, B*0703, B*0705, B*1508, B*3501, B*3503, B*4201, B*5101, B*5102, B*5103, B*5301, B*5401, B*5501, B*5502, B*5601, B*6701, B*7801 |

TABLE I-continued

HLA I supertype families and their antigenic peptide anchor motifs. Examples of useful amino acids binding in pocket B and pocket F are shown as one letter code.

| Supertype | B pocket specificity | Example aa B pocket | F pocket specificity | Example aa F pocket | Example of HLA allele's |
|---|---|---|---|---|---|
| B08 | Undefined | | Aromatic, aliphatic and hydrophbic | F, W, Y, L, I, V, M, Q, A | B*0801, B*0802 |
| B27 | Basic | R, H, K | Aromatic, aliphatic, basic and hydrophbic | F, W, Y, L, I, V, M, Q, A, R, H, K | B*1402, B*1503, B*1509, B*1510, B*1518, B*2702, B*2703, B*2704, B*2705, B*2706, B*2707, B*2709, B*3801, B*3901, B*3902, B*3909, B*4801, B*7301 |
| B44 | Acidic | D, E | Aromatic, aliphatic and hydrophbic | F, W, Y, L, I, V, M, Q, A | B*1801, B*3701, B*4001, B*4002, B*4006, B*4402, B*4403, B*4501 |
| B58 | Small | A, S, T | Aromatic, aliphatic and hydrophbic | F, W, Y, L, I, V, M, Q, A | B*1516, B*1517, B*5701, B*5702, B*5801, B*5802 |
| B62 | Aliphatic | L, I, V, M, Q | Aromatic, aliphatic and hydrophbic | F, W, Y, L, I, V, M, Q, A | B*1501, B*1502, B*1512, B*1513, B*4501, B*4601, B*5201 |

Antigenic peptides P able to bind a given MHC molecule do not necessarily have primary anchor amino acid residues compatible with both main anchoring pockets of the MHC molecule but may have one or no primary anchor amino acids suitable for binding the MHC molecule in question. However, having the preferred primary anchor motif for a given MHC allele increases the affinity of the antigenic peptide for that given allele and thereby the likelihood of making a stable and useful MHC-peptide molecule.

Therefore in one embodiment antigenic peptides can be identified and selected on their ability to bind a given HLA or other MHC molecule based on what amino acids they have at primary anchor positions and/or secondary anchor positions.

Software programs are available that use neural networks or established binding preferences to predict the interaction of specific binding peptides with specific MHC class I alleles. Examples of such programs are www.syfpeithi.de; www.imtech.res.in/raghava/propred1/index.html; and www.cbs.dtu.dk/services/NetMHC/.

Another useful parameter for prediction and selection of useful antigenic peptides are the probability of the binding peptide in question to be generated in vivo by the proteolytic machinery inside cells. For example for a given antigen the combined action of endosolic, cytosolic and membrane bound protease activities as well as the TAP1 and TAP2 transporter specificities can be taken into consideration. However, the proteolytic activity varies a lot among individuals, and for personalized diagnostics, treatment or vaccination it may be desirable to disregard these general proteolytic data. An example of a program predicting the ability of antigenic peptides to be processed is www.cbs.dtu.dk/services/NetCTL/.

The present disclosure relates in one embodiment to antigenic peptides P (or binding peptides P) derived from *Borrelia* antigenic polypeptides or proteins OppA, DbpA, FlhF, FlaB and P37-42. The one or more antigenic peptides P in one embodiment comprises one or more fragments derived from one or more *Borrelia* antigens capable of interacting with one or more MHC class 1 molecules (MHC protein) to provide an MHC-peptide complex. The antigenic peptides P are in one embodiment derived from a *Borrelia* antigen OppA, DbpA, FlhF, FlaB and P37-42 from any *Borrelia* species, and any strain of *Borrelia* species, such as the *Borrelia* species and strains listed herein.

In one embodiment the antigenic peptides P are selected from the group consisting of 8-, 9-, 10,- 11-, and 12-mer peptides P and which are derived from a *Borrelia* antigenic polypeptide selected from the group consisting of OppA, DbpA, FlhF, FlaB and P37-42.

In one embodiment the MHC protein employed within the context of the present disclosure is MHC Class I, and the antigenic peptides P are selected from the group consisting of 8-, 9-, 10,- 11-, and 12-mer peptides that binds to MHC Class I.

Antigenic peptides P (or binding peptides P) derived from *Borrelia* antigenic polypeptides OppA, DbpA, FlhF, FlaB and P37-42 means that the antigenic peptides are predicted from, identified from and/or generated from *Borrelia* antigenic polypeptides OppA, DbpA, FlhF, FlaB and P37-42 by any means known to the skilled person, such as those means disclosed herein.

In one embodiment the generation, identification or prediction of antigenic peptides P derived from a *Borrelia* antigenic polypeptide selected from the group consisting of OppA, DbpA, FlhF, FlaB and P37-42 for a given MHC allele comprises computational analysis, such as computational analysis using prediction software.

For the purposes of the present disclosure, binding peptides P were identified (predicted, generated) by computational prediction using the NetMHC prediction software (http://www.cbs.dtu.dk/services/NetMHC/). Thus, in one embodiment binding peptides P derived from the amino acid sequences of the *Borrelia* proteins OppA, DbpA, FlhF, FlaB and P37-42, each from a number of *Borrelia* species and strains, are generated by computational prediction using the NetMHC prediction software.

Two parameters may be employed when assessing the binding affinity or strength of a given binding peptide P:

i) prediction of the theoretical binding affinity (dissociation constant) of the peptide P to the Class I MHC molecules (such as one or more HLA Class 1 alleles), given in nM, wherein peptides are defined as strong binders if the predicted binding affinity is below 50 nM, and weak binders if the predicted binding affinity is greater than 500 nM, ii) another parameter used to indicate the relative binding strength of a peptide is % Rank. % Rank is defined as the rank score of a given peptide relative to a large number of random natural peptides for a given allele. For example a % Rank score of 2 means that only 2% of random peptides bind the allele with a predicted affinity stronger than the affinity of the peptide in question.

In one embodiment the antigenic peptides are generated from a *Borrelia* antigen OppA, DbpA, FlhF, FlaB and P37-42 derived from any *Borrelia* species, and any strain of *Borrelia* species, such as the *Borrelia* species and strains listed in this application, including but not limited to:

the OppA protein encoded by the species *Borrelia afzelii* (strains ACA-1, PKO and HLJ01; SEQ ID Nos:1-3), *Borrelia Garinii* (strains PBI, PBR and NMJW1; SEQ ID Nos:4-6) and *Borrelia burgdorferi* (strains JD1, LF7A and ZS7; SEQ ID Nos:7-9), the DbpA protein encoded by the species *Borrelia afzelii* (strains PKO, ACA-1, A91 and U01; SEQ ID Nos:10-13), *Borrelia Garinii* (strains PBI, PREF, VS461 AND S40; SEQ ID Nos:14-17) and *Borrelia burgdorferi* (strains B31, PMAI and CA-11.2A; SEQ ID Nos:18-20)

the Flhf protein encoded by the species *Borrelia afzelii* (strains ACA-1 and PKO; SEQ ID Nos:21-22), *Borrelia Garinii* (strains FAR04, PBI and PBR; SEQ ID Nos:23-25) and *Borrelia burgdorferi* (strains B31, N40 and ZS7; SEQ ID Nos:26-28), the FlaB protein encoded by the species *Borrelia afzelii* (strains PKO, 9W10-04, P-GAU and VS461; SEQ ID Nos:29-32), *Borrelia Garinii* (strains PBI, BGVIR and 20047; SEQ ID Nos:33-35) and *Borrelia burgdorferi* (strains A1 and CA8; SEQ ID Nos:36-37), and the P37-42 protein encoded by the species *Borrelia Garinii* (strains noname; SEQ ID Nos:38) and *Borrelia burgdorferi* (strains noname; SEQ ID Nos:39).

In one embodiment the identification of the antigenic peptides P derived from a *Borrelia* antigenic polypeptide selected from the group consisting of OppA (SEQ ID NOs:1-9), DbpA (SEQ ID NOs:10-20), FlhF (SEQ ID NOs:21-28), FlaB (SEQ ID NOs:29-37) and P37-42 (SEQ ID NOs:38-39) for a given MHC allele comprises computational analysis of the prediction of theoretical binding affinity of the peptide P to the MHC molecules using the prediction software NetMHC (http://www.cbs.dtu.dk/services/NetMHC/).

In one embodiment the identification of the antigenic peptides P comprises prediction of a theoretical binding affinity of the peptide P to the one or more MHC Class I alleles with a binding affinity threshold (nM) (or simply 'affinity threshold').

In one embodiment the identification of the antigenic peptides P comprises prediction of a theoretical binding affinity of the peptide P to the MHC Class I molecules with an affinity threshold of 1000 nM (binder), 500 nM (weak binder) or 50 nM (strong binder).

In one embodiment identification of binding peptides P from *Borrelia* proteins OppA, DbpA, FlhF, FlaB and P37-42 is carried out using an affinity threshold of 1000 nM for a number of individual HLA class I allele. In one embodiment prediction of binding peptides P from *Borrelia* proteins OppA, DbpA, FlhF, FlaB and P37-42 is carried out using an affinity threshold of 1000 nM for all known HLA class I alleles. In one embodiment prediction of binding peptides P from *Borrelia* proteins OppA, DbpA, FlhF, FlaB and P37-42 is carried out using an affinity threshold of 1000 nM for HLA class I alleles of interest.

In one embodiment identification of binding peptides P from the *Borrelia* proteins OppA, DbpA, FlhF, FlaB and P37-42 is carried out using an affinity threshold of 50 nM, such as 100 nM, such as 150 nM, such as 200 nM, such as 250 nM, such as 300 nM, such as 400 nM, such as 500 nM, such as 600 nM, such as 700 nM, such as 800 nM, such as 900 nM, such as 1000 nM, such as 1250 nM, such as 1500 nM, such as 1750 nM, such as 2000 nM, such as 2500 nM, such as 3000 nM, such as 3500 nM, such as 4000 nM, such as 4500 nM, such as 5000 nM, such as 6000 nM, such as 7000 nM, such as 8000 nM. such as 9000 nM. such as 10000 nM.

In one embodiment the antigenic peptides P has a theoretical binding affinity of less than 50 nM, such as 50-100 nM, such as 100-150 nM, such as 150-200 nM, such as 200-250 nM, such as 250-300 nM, such as 300-400 nM, such as 400-500 nM, such as 500-600 nM, such as 600-700 nM, such as 700-800 nM, such as 800-900 nM, such as 900-1000 nM, such as 1000-1250 nM, such as 1250-1500 nM, such as 1500-1750 nM, such as 1750-2000 nM, such as 2000-2500 nM, such as 2500-3000 nM, such as 3000-3500 nM, such as 3500-4000 nM, such as 4000-4500 nM, such as 4500-5000 nM, such as 5000-6000 nM, such as 6000-7000 nM, such as 7000-8000 nM, such as 8000-9000 nM, such as 9000-10000 nM for individual HLA class I alleles.

In one embodiment the identification of the antigenic peptides P comprises prediction of a theoretical binding affinity of the peptide P to the MHC Class I molecules with an affinity threshold for one or more HLA class 1 alleles.

In one embodiment the identification of the antigenic peptides P comprises prediction of a theoretical binding affinity of the peptide P to the MHC Class I molecules with an affinity threshold for one or more HLA class 1 alleles selected from the group consisting of A*0201, C*0701, A*0101, A*0301, C*0702, C*0401, B*4402, B*0702, B*0801, C*0501, C*0304, C*0602, A*1101, B*4001, A*2402, B*3501, C*0303, B*5101, C*1203, B*1501, A*2902, A*2601, A*3201, C*0802, A*2501, B*5701, B*1402, C*0202, B*1801, B*4403, C*0401, C*0701, C*0602, A*0201, A*2301, C*0202, A*0301, C*0702, B*5301, B*0702, C*1601, B*1503, B*5801, A*6802, C*1701, B*4501, B*4201, A*3001, B*3501, A*0101, C*0304, A*3002, B*0801, A*3402, A*7401, A*3303, C*1801, A*2902, B*4403, B*4901, A*0201, C*0401, A*2402, C*0702, C*0701, C*0304, A*0301, B*0702, B*3501, C*0602, C*0501, A*0101, A*1101, B*5101, C*1601, B*4403, C*0102, A*2902, C*0802, B*1801, A*3101, B*5201, B*1402, C*0202, C*1203, A*2601, A*6801, B*0801, A*3002, B*4402, A*1101, A*2402, C*0702, C*0102, A*3303, C*0801, C*0304, A*0201, B*4001, C*0401, B*5801, B*4601, B*5101, C*0302, B*3802, A*0207, B*1501, A*0206, C*0303, B*1502, A*0203, B*4403, C*1402, B*3501, C*0602, B*5401, B*1301, B*4002, B*5502 and A*2601.

In one embodiment the identification of the antigenic peptides P comprises prediction of a theoretical binding affinity of the peptide P to the MHC Class I molecules with an affinity threshold for one or more HLA class 1 alleles selected from the group consisting of HLA-A*A0101, A0201, A0301, A1101, A2402, A2501, A2601, A2902, A3101, A3201, A6801, B0702, B0801, B1503, B1801, B3501, B4002, B4402, B4501 and B5101.

In one embodiment the identification of the antigenic peptides P comprises prediction of a theoretical binding affinity of the peptide P to the MHC Class I molecules with an affinity threshold of 50 nM, such as 100 nM, such as 150 nM, such as 200 nM, such as 250 nM, such as 300 nM, such as 400 nM, such as 500 nM, such as 600 nM, such as 700 nM, such as 800 nM, such as 900 nM, such as 1000 nM, such as 1250 nM, such as 1500 nM, such as 1750 nM, such as 2000 nM, such as 2500 nM, such as 3000 nM such as 3500 nM, such as 4000 nM, such as 4500 nM, such as 5000 nM, such as 6000 nM, such as 7000 nM, such as 8000 nM, such as 9000 nM, such as 10000 nM for one or more HLA class 1 alleles selected from the group consisting of HLA-A*A0101, A0201, A0301, A1101, A2402, A2501, A2601, A2902, A3101, A3201, A6801, B0702, B0801, B1503, B1801, B3501, B4002, B4402, B4501 and B5101.

In another embodiment the identification of the antigenic peptides P comprises prediction of a rank score relative binding strength of the peptide P to the one or more MHC Class I alleles with a relative binding strength threshold (% Rank).

In one embodiment the identification of the antigenic peptides P derived from a *Borrelia* antigenic polypeptide selected from the group consisting of OppA (SEQ ID NOs:1-9), DbpA (SEQ ID NOs:10-20), FlhF (SEQ ID NOs:21-28), FlaB (SEQ ID NOs:29-37) and P37-42 (SEQ ID NOs:38-39) for a given MHC allele comprises computational analysis of the prediction of a rank score relative binding strength of the peptide P to the one or more MHC Class I alleles with a relative binding strength threshold (% Rank) using the prediction software NetMHC (http://www.cbs.dtu.dk/services/NetMHC/).

In one embodiment the identification of the antigenic peptides P comprises prediction of the relative binding strength of the peptide P to the one or more MHC Class I alleles with a threshold of 0.5% Rank, such as 1% Rank, such as 1,5% Rank, such as 2% Rank.

In one embodiment the antigenic peptides P has a rank score relative binding strength of less than 0.5% Rank, such as 0,5-1% Rank, such as 1-1,5% Rank, such as 1,5-2, such as 2-2,5, such as 2,5-3, such as 3-3,5 such as 3,5-4, such as 4-4,5, such as 4,5-5% Rank.

The present disclosure relates in one embodiment to one or more antigenic peptides P, MHC-peptide complexes comprising one or more antigenic peptides P and one or more MHC multimers comprising one or more antigenic peptides P, such as the antigenic peptides P disclosed in Tables A to E.

In one embodiment the antigenic peptide P of the present disclosure is selected from the sequences included in Tables A to E herein above (Tables A1-A20, B1-B19, C1-C20, D1-D20 and E1-E20).

Preferred binding peptides P derived or predicted from *Borrelia* protein OppA capable of interacting with one or more MHC class 1 molecules are listed in Table A:

TABLE A

Predicted MHC class 1 binding peptides P derived from Borrelia antigen OppA (8-, 9-, 10-, 11-, and 12-mers), predicted as detailed in Example 17. The binding peptides P are sorted per HLA-allele.

OppA antigenic polypeptide sequences

BORRELIA AFZELLI.ACA-1 (SEQ ID NO: 1)

BORRELIA AFZELLI.PKO (SEQ ID NO: 2)

BORRELIA AFZELLI.HLJ01 (SEQ ID NO: 3)

BORRELIA GARINII.PBI (SEQ ID NO: 4)

BORRELIA GARINII.PBR (SEQ ID NO: 5)

BORRELIA GARINII.NMJW1 (SEQ ID NO: 6)

BORRELIA BURGDORFERI.JD1 (SEQ ID NO: 7)

BORRELIA BURGDORFERI.LF7A (SEQ ID NO: 8)

BORRELIA BURGDORFERI.ZS7 (SEQ ID NO: 9)

| Predicted OppA antigenic peptides P | HLA-allele |
|---|---|
| 9mer: WSDGVAITA; TTNDNSTAY; RSDYYSSAV; YSSAVNAIY; AIDRETLTY; FLSIF TQGY; YTQFSSHNY; FLSILTHGY; FLSIFTHGY; TTNDSSTAY; WSDGVPITA; AIDRE TLAY; LSDLFEGLV; WSDGTAITA; VSPQLATYY; TSQYSNPDY; TTQERGQFY; FTPDK LGYY (SEQ ID NOs: 40-57)<br>10mer: YTTNDNSTAY; TTNDNSTAYK; LRSDYYSSAV; YSSAVNAIY; YSSAVNATYF; SSAVNATYFY; LAIDRETLTY; ITPNESSYSY; YLNTKSNGNY; TELSIFTQGY; GYTQ FSSHNY; TELSILTHGY; TELSIFTHGY; YTTNDSSTAY; TTNDSSTAYK; YLNTRSNGN Y; ATPNESSYSY; SSHNYSNSEY; YVFEKNDKYY; LAIDRETLAY; YLNTKANGNY; YVE EKNNKYY; ILSDLFEGLV; LVDPKTASPY; TSEAADVNRY; VSPQLATYYY; HTHNEDAV | A0101 TABLE A-1 |

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

RY; NTSQYSNPDY; GFTPDKLGYY; FTPDKLGYYY (SEQ ID NOs: 58-87)
11mer: FYTTNDNSTAY; YTTNDNSTAYK; DYYSSAVNAIY; YSSAVNAIYFY; TLAIDR
ETLTY; LTFLSIFTQGY; FSSHNYSSPEY; LTFLSILTHGY; LTFLSIFTHGY; FYTTND
SSTAY; YTTNDSSTAYK; ATFLSIFTQGY; FSSHNYSNSEY; TLAIDRETLAY; LAIDRE
TLAYK; FSSHNYSNPEY; RLVDPKTASPY; LVDPKTASPYA; ITSEAADVNRY; QLDVSP
QLATY; ASHPLSENLLY; ENTSQYSNPDY; YSNPDYDQALV; GFTPDKLGYYY; FTPDKL
GYYYT (SEQ ID NOs: 88-112)
12mer: TFYTTNDNSTAY; FYTTNDNSTAYK; YTTNDNSTAYKM; TTNDNSTAYKMY; SD
YYSSAVNAIY; DYYSSAVNAIYF; YSSAVNAIYFY; YSSAVNAIYFYA; LTLAIDRETL
TY; PLTELSIFTQGY; LTFLSIFTQGYT; QFSSHNYSSPEY; FSSHNYSSPEYN; PLTEL
SILTHGY; LTFLSILTHGYT; PLTELSIFTHGY; LTELSIFTHGYT; TFYTTNDSSTAY;
FYTTNDSSTAYK; YTTNDSSTAYKM; TTNDSSTAYKMY; NDYYSSAVNAIY; PATELSIF
TQGY; QFSSHNYSNSEY; FSSHNYSNSEYN; SSEVEVQEIAFY; AFYTTNDSSTAY; LTL
AIDRETLAY; TLAIDRETLAYK; QFSSHNYSNPEY; FSSHNYSNPEYN; QRLVDPKTASP
Y; RLVDPKTASPYA; PITSEAADVNRY; TQLDVSPQLATY; QLDVSPQLATYY; NASHPL
SENLLY; SENTSQYSNPDY; QYSNPDYDQALV; GGFTPDKLGYYY; GFTPDKLGYYYT; F
TPDKLGYYYTK (SEQ ID NOs: 113-154)

9mer: KLQKLLFLI; KLLFLIIFF; LLELIIFFL; FLIIFELTE; LIIFELTEL; SLGAE    A0201
PSSL; KMIDTMEKG; IIWSDGVAI; AIDEKTLEI; AVNAIYFYA; AIYFYAENT; YFYAF   TABLE
NTHI; VLDDGTTPT; YSYAKNLEL; NLELENPEI; NQWKKILNI; KILNIDVEL; WIGDY   A-2
ADPL; IIIEKDFPI; YIYGNSYLF; KLQKLLFSV; KLLESVIFF; LLESVIFFL; SVIFF
LTFL; SLGSEPSSL; KMIDTMERG; YFYAFNTYI; VLDNGTTPT; KLQKSLFLI; SLFLI
IFFL; MVTSGPFKL; ELDAIFVSI; YFYAFNTTV; WIGDYADPA; KLQKSLLEL; LQKSL
LFLI; SLLFLIIFF; ITWSDGVPI; YFYAFNTKV; KLQRSLFLI; LVHQSFIPV; HQSFI
PVPV; YSYAKSLEL; SLELENPEI; SQSRTNFTL; TLSLLTAGI; LLTAGILCA; QLAEK
QELV; ILSDLFEGL; DLFEGLVNV; VVWSWQRLV; KQAPDTLGV; ALNDTTLEV; FLAML
AHPS; AMLAHPSMV; LAHPSMVPV; TVINKVTYL; YLPITSEAA; YTVPINQFA; KTMGT
QLDV; TQLDVSPQL; LLEEAGENA; SMWKKNLGV; TMHTHNEDA; WIADYDDAA; LLGRD
VPAI (SEQ ID NOs: 155-220)
10mer: MKLQKLLFLI; KLQKLLFLII; KLLFLIIFFL; LLELIIFFLT; LFLIIFFLTF;
FLIIFELTFL; LIIFELTFLC; KMIDTMEKGL; TLESPKPYFI; IDMLVHQSFI; MLVH
QSFIPI; KMYENGELDA; GELDAIFSAI; AIFSAIPPDL; KLRSDYYSSA; YAFNTHIKP
L; KVLDDGTTPT; KNLELENPEI; KKILNIDVEL; YADPLTELSI; FLSIFTQGYT; EII
IEKDEPI; IIIEKDEPIA; FLSILTHGYT; FLSIFTHGYT; MKLQKLLFSV; KLQKLLES
VI; KLLESVIFFL; LLESVIFFLT; FSVIFELTFL; KMIDTMERGL; KMYENKELDA; KE
LDAIFGSI; AIFGSIPPDL; YAENTYIKPL; MKLQKSLFLI; KLQKSLFLII; KSLFLII
FFL; SLFLIIFELT; KELDAIFVSI; AIFVSIPPDL; KLRNDYYSSA; IYFYAFNTTV; Y
AFNTTVKPL; MKLQKSLLEL; KLQKSLLFLI; KSLLFLIIFF; SLLFLIIFFL; KITWSD
GVPI; KMYENEELDA; MKLQRSLFLI; KLQRSLFLII; RSLFLIIFFL; KMIDTMERGI;
MLVHQSFIPV; VELEEITFYT; KSLELENPEI; FTLSLLTAGI; TLSLLTAGIL; SLLTA
GILCA; TQLAEKQELV; NILSDLFEGL; ILSDLFEGLV; SDLFEGLVNV; KALNDTTLEV;
ALNDTTLEVT; FLAMLAHPSM; LAMLAHPSMV; AMLAHPSMVP; MLAHPSMVPV; SMVP
VDKVLI; KLLEEAGFNA; SSMWKKNLGV; SMWKKNLGVE; TMHTHNEDAV (SEQ ID
NOs: 221-295)
11mer: QKLLFLIIFFL; KLLFLIIFELT; LLFLIIFELTF; LELIIFELTEL; FLIIFF
LTFLC; SLDPQLADDNV; SKMIDTMEKGL; KMIDTMEKGLI; FIDMLVHQSFI; DMLVHQ
SFIPI; KMYENGELDAI; KLRSDYYSSAV; MKLQKLLESVI; QKLLESVIFFL; KLLFSV
IFELT; LLESVIFFLTF; LESVIFELTFL; SKMIDTMERGL; KMIDTMERGLI; KMYENK
ELDAI; AIYFYAFNTYI; QKSLFLIIFFL; KSLLFLIIFFL; SLELIIFELTF; SLDPQL
AEDNV; KLRNDYYSSAV; AIYFYAFNTTV; MKLQKSLLFLI; KSLLELIIFFL; SLLFLI
IFELT; KMYENEELDAI; AIYFYAFNTKV; QRSLFLIIFFL; RSLFLIIFFLT; SKMIDT
MERGI; KMIDTMERGIV; DMLVHQSFIPV; MLVHQSFIPVP; NFTLSLLTAGI; FNILSD
LEEGL; NILSDLFEGLV; LSDLFEGLVNV; SDLFEGLVNVS; VKALNDTTLEV; AFLAML
AHPSM; FLAMLAHPSMV; AMLAHPSMVPV; MLAHPSMVPVD; ALDKDIIADKV; ASSMWK
KNLGV (SEQ ID NOs: 296-345)
12mer: LQKLLFLIIFFL; QKLLFLIIFFLT; KLLFLIIFELTF; LLFLIIFELTFL; LF
LIIFELTFLC; FLIIFFLTFLCC; GSKMIDTMFKGL; SKMIDTMEKGLI; KMIDTMEKGL
IT; IDMLVHQSFIPI; MLVHQSFIPIPI; KLKERIPNEKYV; FIQNQWKKILNI; YLNTK
SNGNYEI; MKLQKLLESVIF; LQKLLESVIFFL; QKLLESVIFFLT; KLLESVIFELTE;
LLESVIFFLTFL; GSKMIDTMERGL; SKMIDTMERGLI; KMIDTMERGLIT; YLNTRSNG
NYEI; LQKSLFLIIFFL; QKSLELIIFELT; KSLELIIFELTF; SLFLIIFELTEL; SSL
DPQLAEDNV; ASKMIDTMERGL; NAIYFYAFNTTV; LQKSLLELIIFFL; KSLLFLIIFFL
T; SLLFLIIFELTF; YLNTKANGNYEI; LQRSLELIIFFL; QRSLELIIFELT; RSLFLI
IFELTF; ASKMIDTMERGI; SKMIDTMERGIV; KMIDTMERGIVT; IDMLVHQSFIPV; D
MLVHQSFIPVP; MLVHQSFI PVPV; TNFTLSLLTAGI; EFNILSDLFEGL; FNILSDLFE
GLV; ILSDLFEGLVNV; LSDLEEGLVNVS; SDLFEGLVNVSP; GVKALNDTTLEV; AAFL
AMLAHPSM; AFLAMLAHPSMV; FLAMLAHPSMVP; LAMLAHPSMVPV; AMLAHPSMVPVD;
MLAHPSMVPVDK; KLSQWVVNERIV; AASSMWKKNLGV; KLGYYYTKDMYI; VLDDGTT
PTRRI (SEQ ID NOs: 346-405)

9mer: FLTFLCCNK; GGNKPGLAK; AITAEGIRK; KSYLRILNK; GSNYSEMVK; KSTIK    A0301
NGQK; NIVTSGPFK; VTSGPFKLK; RITPNESSY; ELENPEIAK; GSNYAEMVK; TAYKM  TABLE
YENK; RIAPNESSY; FLTFLCCSK; KAKEGVSFK; GGNRPGLAK; ILNKETGSK; GSKYV  A-3
EMVK; KSAIKNGQK; NMVTSGPFK; VSIPPDLIK; SEYNELIKK; KVRPLDNVK; LTFLC
CNNK; KSVIKNGQK; RLAEKWENK; KTASPYASY; VLINRFGEK; HLVTSGAYK; KALNM

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

ALDK; LLYNTSESH; AIAASSMWK; IAASSMWKK; ALVNAAKAK; YTKDMYIKK (SEQ ID NOs: 406-440)
10mer: FFLTFLCCNK; QLADDNVGSK; GSKMIDTMFK; TVYTFTLREK; VAITAEGIRK; RKSYLRILNK; KSYLRILNKE; ILNKETGSNY; TGSNYSEMVK; YSEMVKSTIK; TLEI TLESPK; IVTSGPFKLK; VTSGPFKLKE; KLKERIPNEK; TTNDNSTAYK; FSAIPPDLI K; AIYFYAFNTH; YFYAFNTHIK; KPLDNVKVRK; AIDRETLTYK; RRITPNESSY; LEL FNPEIAK; KLKYNTSEAH; APIYIYGNSY; YIYGNSYLFR; GNSYLERNDK; REDLSQLK LK; FDLSQLKLKK; TGSNYAEMVK; TTNDSSTAYK; STAYKMYENK; AIYFYAENTY; YF YAFNTYIK; RRIAPNESSY; FELTFLCCSK; LTFLCCSKEK; EKAKEGVSFK; QLAEDNV ASK; ASKMIDTMER; RILNKETGSK; ILNKETGSKY; YVEMVKSAIK; ENMVTSGPFK; M VTSGPFKLK; FVSIPPDLIK; YFYAFNTTVK; TTVKPLDNVK; ATPNESSYSY; NSEYNE LIKK; RQAEEIIIEK; VPITAEGIRK; AIYFYAFNTK; RPLDNVKVRK; AIDRETLAYK; FLTFLCCNNK; KERKEGVSFK; TVYTENLREK; YVEMVKSVIK; KPLDNVKIRK; GEIQP RLAEK; PRLAEKWENK; KQAPDTLGVK; KVLINREGEK; VLINREGEKW; EHLVTSGAYK; HLVTSGAYKL; KLSQWVVNER; VPINQ FAQLK; RKALNMALDK; ALDKDIIADK; IAIA ASSMWK; AIAASSMWKK; HTHNEDAVRY; AVRYAWIADY (SEQ ID NOs: 487-560)
11mer: GTVYTFTLREK; TVYTFTLREKI; IRKSYLRILNK; RKSYLRILNKE; KSYLRI LNKET; KTLEITLESPK; LAIDRETLTYK; NLELENPEIAK; KLKYNTSEAHK; REDLSQ LKLKK; LRILNKETGSK; NMVTSGPFKLK; KLKYNTSDANK; KTGGNRPGLAK; NAIYFY AFNTK; AIYFYAFNTKV; GTVYTENLREK; TVYTENLREKI; SLELENPEIAK; KLKYNT NEANK; ILERFDLSQLK; DKVLINRFGEK; RIAIAASSMWK; IAIAASSMWKK; AIAASS MWKKN (SEQ ID NOs: 561-585)
12mer: IIFFLTFLCCNK; DGTVYTFTLREK; GTVYTFTLREKI; TVYTFTLREKII; GI RKSYLRILNK; IRKSYLRILNKE; RKSYLRILNKET; EKTLEITLESPK; KTLEITLESP KP; AIFSAIPPDLIK; AIYFYAFNTHIK; TLAIDRETLTYK; ITPNESSYSYAK; KNLEL FNPEIAK; LKLKYNTSEAHK; KLKYNTSEAHKK; ILRKAEEIIIEK; ERFDLSQLKLKK; VIFFLTFLCCNK; SPENIVTSGPFK; AIFGSIPPDLIK; AIYFYAFNTYIK; IIFELTEL CCSK; TVYTFTLREKIT; YLRILNKETGSK; SPENMVTSGPFK; AIFVSIPPDLIK; AIY FYAFNTTVK; ATPNESSYSYAK; LKLKYNTSDANK; KLKYNTSDANKK; ILRQAEEIIIE K; TMFRGLITGDPK; PKTGGNRPGLAK; KTGGNRPGLAKS; VNAIYFYAFNTK; NAIYFY AFNTKV; AIYFYAFNTKVR; KVRPLDNVKVRK; TLAIDRETLAYK; DGTVYTENLREK; G TVYTENLREKI; TVYTENLREKIT; KSLELENPEIAK; SLELENPEIAKT; LKLKYNTNE ANK; NILERFDLSQLK; VVWSWQRLVDPK; MLAHPSMVPVDK; VDKVLINRFGEK; VLIN RFGEKWTK; KPEHLVTSGAYK; RVRKALNMALDK; KTPDYASWPMDK; QRIAIAASSMWK; RIAIAASSMWKK; IAIAASSMWKKN; AIAASSMWKKNL; SMWKKNLGVEAK (SEQ ID NOs: 586-644)

9mer: FLTFLCCNK; SKMIDTMFK; GGNKPGLAK; GTVYTFTLR; AITAEGIRK; KSYLR A1101
ILNK; GSNYSEMVK; NIVTSGPFK; VTSGPFKLK; TTNDNSTAY; TNDNSTAYK; SAIPP TABLE
DLIK; SAVNAIYFY; AVNAIYFYA; KALTLAIDR; AIDRETLTY; RITPNESSY; NESSY A-4
SYAK; ELENPEIAK; NGNGFPILK; YTQFSSHNY; KAEEIIIEK; NSYLFRNDK; LSQLK
LKNK; LTFLSIFTH; GSNYAEMVK; TTNDSSTAY; TNDSSTAYK; TAYKMYENK; GSIPP
DLIK; FYAFNTYIK; RIAPNESSY; FLTFLCCSK; KAKEGVSFK; GGNRPGLAK; ILNKE
TGSK; GSKYVEMVK; KSAIKNGQK; NMVTSGPFK; VSIPPDLIK; TVKPLDNVK; SEYNE
LIKK; QAEEIIIEK; RGLITGDPK; IYFYAFNTK; AIDRETLAY; LTFLCCNNK; GTVYT
FNLR; KSVIKNGQK; EIQPRLAEK; RLAEKWENK; NTVWTFHLR; SWQRLVDPK; KTASP
YASY; VLINRFGEK; HLVTSGAYK; LSQWVVNER; RIVAERNPR; KALNMALDK; AIAAS
SMWK; IAASSMWKK; AATFLNNER; ALVNAAKAK; TTQERGQFY; AIPVYHYVR; WVGGE
TPDK; YTKDMYIKK (SEQ ID NOs: 645-711)
10mer: GSKMIDTMFK; TVYTFTLREK; VAITAEGIRK; RKSYLRILNK; KSYLRILNKE; TGSNYSEMVK; YSEMVKSTIK; TLEITLESPK; ENIVTSGPFK; IVTSGPFKLK; VTSG PFKLKE; TTNDNSTAYK; FSAIPPDLIK; SSAVNAIYFY; AIYFYAFNTH; YFYAFNTHI K; KPLDNVKVRK; AIDRETLTYK; ITPNESSYSY; LELENPEIAK; KSNGNYEIAR; GYT QFSSHNY; SSHNYSSPEY; SSPEYNELIK; KSDLELDPIK; RKAEEIIIEK; APIYIYGN SY; YIYGNSYLFR; GNSYLFRNDK; GSKMIDTMER; TGSNYAEMVK; YAEMVKSTIK; TT NDSSTAYK; STAYKMYENK; FGSIPPDLIK; AIYFYAFNTY; YFYAFNTYIK; RRIAPNE SSY; IAPNESSYSY; RSNGNYEIAR; LTFLCCSKEK; QLAEDNVASK; ASKMIDTMER; R ILNKETGSK; TGSKYVEMVK; YVEMVKSAIK; MVTSGPFKLK; VSIPPDLIKD; YFYAFNTTVK; TTVKPLDNVK; ATPNESSYSY; SSHNYSNSEY; SNSEYNELIK; NSEYNELIKK; RQAEEIIIEK; VPITAEGIRK; AIYFYAFNTK; RPLDNVKVRK; AIDRE TLAYK; FLTFLCCNNK; TVYTENLREK; YVEMVKSVIK; KPLDNVKIRK; SSHNYSNPEY; GEIQPRLAEK; WSWQRLVDPK; KQAPDTLGVK; KVLINRFGEK; EHLVTSGAYK; KLSQ WVVNER; SEAADVNRYK; VPINQFAQLK; VSPQLATYYY; RKALNMALDK; ALDKDIIAD K; IAIAASSMWK; AIAASSMWKK; KTMLDTMHTH; AVRYAWIADY; YDQALVNAAK; YYT KDMYIKK (SEQ ID NOs: 712-793)
11mer: VGSKMIDTMFKG; GSKMIDTMFKG; GTVYTFTLREK; TVYTFTLREKI; GVAITA EGIRK; IRKSYLRILNK; KTLEITLESPK; NIVTSGPFKLK; RIPNEKYVVEK; YTTNDN STAYK; TTNDNSTAYKM; YSSAVNAIYFY; LAIDRETLTYK; YSSPEYNELIK; SSPEYN ELIKK; IYIYGNSYLFR; ITERFDLSQLK; YTTNDSSTAYK; TTNDSSTAYKM; SSTAYK MYENK; STAYKMYENKE; IFGSIPPDLIK; SIPPDLIKDLK; NAIYFYAENTY; VASKMI DTMFR; NMVTSGPFKLK; IFVSIPPDLIK; RATPNESSYSY; ATFLSIFTQGY; YSNSEY NELIK; ISERFDLSQLK; KTGGNRPGLAK; RIPNEKYVFEK; NAIYFYAFNTK; AIYFYA FNTKV; LAIDRETLAYK; GTVYTENLREK; TVYTENLREKI; SIPPDLIKNLK; SLELEN PEIAK; YSNPEYNELIK; ILERFDLSQLK; TGEIQPRLAEK; IVNGAAIAQGK; LAHPSM VPVDK; DKVLINRFGEK; LINRFGEKWTK; TSEAADVNRYK; TVPINQFAQLK; ATYYYE

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

FNTTR; SQPDIGGVTLK; ASHPLSENLLY; RIAIAASSMWK; IAIAASSMWKK; AIAASS MWKKN; YYYTKDMYIKK (SEQ ID NOs: 794-849)
12mer: IIFFLTFLCCNK; NVGSKMIDTMFK; VGSKMIDTMEKG; GSKMIDTMEKGL; DG TVYTFTLREK; GTVYTFTLREKI; TVYTFTLREKII; GIRKSYLRILNK; KETGSNYESEM VK; EKTLEITLESPK; KTLEITLESPKP; ENIVTSGPFKLK; FYTTNDNSTAYK; YTTND NSTAYKM; TTNDNSTAYKMY; AIFSAIPPDLIK; SAIPPDLIKDLK; YSSSAVNAIYFY; AIYFYAFNTHIK; TLAIDRETLTYK; ITPNESSYSYAK; KNLELENPEIAK; KICEFIQN QWKK; NYSSPEYNELIK; YSSPEYNELIKK; SSPEYNELIKKS; PIYIYGNSYLER; IYG NSYLERNDK; NITERFDLSQLK; VIFFLTELCCNK; KETGSNYAEMVK; SPENIVTSGPF K; FYTTNDSSTAYK; YTTNDSSTAYKM; TTNDSSTAYKMY; DSSTAYKMYENK; SSTAYK MYENKE; STAYKMYENKEL; AIFGSIPPDLIK; GSIPPDLIKDLK; VNAIYFYAENTY; AIYFYAFNTYIK; IAPNESSYSYAK; IIFFLTFLCCSK; NVASKMIDTMER; TVYTFTLRE KIT; SPENMVTSGPFK; ENMVTSGPFKLK; AIFVSIPPDLIK; VSIPPDLIKDLK; AIYE YAFNTTVK; RRATPNESSYSY; ATPNESSYSYAK; PATFLSIFTQGY; YSNSEYNELIKK; NISERFDLSQLK; TMFRGLITGDPK; PKTGGNRPGLAK; ERIPNEKYVFEK; VNAIYFY AFNTK; NAIYFYAFNTKV; AIYFYAFNTKVR; TLAIDRETLAYK; DGTVYTFNLREK; GTVYTENLREKI; TVYTENLREKIT; GSIPPDLIKNLK; KSLELENPEIAK; NYSNPEYNEL IK; YSNPEYNELIKK; NILERFDLSQLK; PTGEIQPRLAEK; VVWSWQRLVDPK; HIVNG AAIAQGK; MLAHPSMVPVDK; VDKVLINRFGEK; VLINREGEKWTK; KPEHLVTSGAYK; ITSEAADVNRYK; YTVPINQ FAQLK; TVPINQ FAQLKK; LATYYEENTTR; RVRKALNM ALDK; ISQPDIGGVTLK; KTPDYASWPMDK; NASHPLSENLLY; QRIAIAASSMWK; RIA IAASSMWKK; SMWKKNLGVEAK; FTPDKLGYYYTK; GYYYTKDMYIKK (SEQ ID NOs: 850-940)

9mer: KLQKLLFLI; FLIIFFLTF; IDMLVHQSF; SFIPIPIHI; YSSAVNAI; VNAIY FYAF; IYFYAFNTH; YFAFNTHI; SYAKNLELF; IFTQGYTQF; IYIYGNSYL; YIYGN SYLF; SYLERNDKW; KWTGWNTNI; IYFYAENTY; YFAFNTYI; KLQKSLFLI; IYFYA FNTT; RIPNEKYVF; KLQRSLFLI; RSLFLIIFF; SYAKSLELF; SYPGNMHIV; RYWDN AHTVI; YWDNAHTVI; VYTVPINQF; QLATYYYEF; FYQQAEDLL; VYHYVRTHL; YYYTK DMYI (SEQ ID NOs: 941-970)  A2402 TABLE A-5
10mer: LFLIIFFLTF; ISPDGTVYTF; VYTFTLREKI; NYSEMVKSTI; IFSAIPPDLI; DYYSSAVNAI; YSSAVNAIY; IYFYAFNTHI; SYSYAKNLEL; YSYAKNLELF; SYAK NLELEN; GYPNGNGFPI; SIFTQGYTQF; IFTQGYTQFS; NYSSPEYNEL; IYIYGNSYL F; YIYGNSYLFR; LESVIFFLTF; NYAEMVKSTI; IFGSIPPDLI; IYFYAFNTYI; KYV EMVKSAI; IFVSIPPDLI; IYFYAFNTTV; NYSNSEYNEL; ISSDGTVYTF; IYFYAENT KV; VYTENLREKI; KYVEMVKSVI; SYSYAKSLEL; YSYAKSLELF; SYAKSLELEN; NY SNPEYNEL; KWTGWNTNIL; RYWDNAHTVI; IVYTVPINQF; VYTVPINQFA; PQLATYY YEF; VYHYVRTHLV; GYYYTKDMYI (SEQ ID NOs: 971-1010)
11mer: YFIDMLVHQSF; YSSSAVNAIYF; AIYFYAFNTHI; IYFYAFNTHIK; SYSYAK NLELF; YSYAKNLELEN; SYAKNLELENP; PIYIYGNSYLF; IYIYGNSYLFR; AIYFYA FNTYI; IYFYAFNTYIK; FYAFNTYIKPL; SYSYAKSLELF; YSYAKSLELEN; SYAKSL ELFNP; YYEFNTTRPPF; DYASWPMDKRI (SEQ ID NOs: 1011-1027)
12mer: PYFIDMLVHQSF; YFIDMLVHQSFI; RSDYYSSAVNAI; DYYSSAVNAIYF; YY SSAVNAIYFY; NAIYFYAFNTHI; AIYFYAFNTHIK; IYFYAFNTHIKP; SSYSYAKNLE LF; SYSYAKNLELEN; YSYAKNLELENP; SYAKNLELENPE; GWIGDYADPLTE; APIYI YGNSYLF; PIYIYGNSYLFR; IYIYGNSYLERN; NAIYFYAFNTYI; AIYFYAENTYIK; IYFYAFNTYIKP; VYTFTLREKITW; RNDYYSSAVNAI; RSLFLIIFELTF; VYTENLRE KITW; SSYSYAKSLELF; SYSYAKSLELEN; YSYAKSLELENP; SYAKSLELENPE; KWE NKDNTVWTF; VSPQLATYYYEF; YYYEFNTTRPPF; YYEFNTTRPPEN; AWIADYDDAAT F (SEQ ID NOs: 1028-1059)

9mer: ETGSNYSEM; YVVEKNDKY; TTNDNSTAY; RITPNESSY; PIYIYGNSY; TTNDS STAY; RIAPNESSY; YVFEKNDKY; YVFEKNNKY; KTASPYASY; HTVINKVTY; DVSPQ LATY; FTPDKLGYY (SEQ ID NOs: 1060-1072)  A2501 TABLE A-6

9mer: ETGSNYSEM; STIKNGQKY; YVVEKNDKY; TTNDNSTAY; YSSAVNAIY; SAVNA IYFY; EAHKKICEF; YTQFSSHNY; YIYGNSYLF; SVIFELTEL; ETGSNYAEM; TTNDS STAY; DSSTAYKMY; SAIKNGQKY; YVFEKNDKY; SVIKNGQKY; YVFEKNNKY; EANKK ICEF; IVAERNPRY; TVINKVTYL; DVSPQLATY; DAATELNNF; TTQERGQFY; LVKPW VGGF; FTPDKLGYY (SEQ ID NOs: 1073-1097)  A2601 TABLE A-7
10mer: STIKNGQKYF; YVVEKNDKYY; QVEVQEITFY; YTTNDNSTAY; ITPNESSYSY; ELENEEWTTY; YTTNDSSTAY; EVEVQEITFY; ATPNESSYSY; YVFEKNDKYY; EVEV QEIAFY; SVIKNGQKYF; YVFEKNNKYY; EVELEEITFY; DVSPQLATYY; HTHNEDAVR Y; DVPAIPVYHY; HLVKPWVGGF; GFTPDKLGYY; FTPDKLGYYY (SEQ ID NO2: 1098-1117)
11mer: EIARAGWIGDY; NEVEVQEITFY; EVEVQEITFYT; SEVEVQEIAFY; EVEVQE IAFYT; EIARAGWIGDY; EVELEEITFYT; DPKTASPYASY; ERIVAERNPRY; GGFTPD KLGYY; GFTPDKLGYYY; FTPDKLGYYYT (SEQ ID NOs: 1118-1129)
12mer: EIAKTLLAEAGY; YEIARAGWIGDY; EIARAGWIGDYA; SNEVEVQEITFY; NE VEVQEITFYT; EVEVQEITFYTT; SSEVEVQEIAFY; SEVEVQEIAFYT; EVEVQEIAFY TT; EVELEEITFYTT; DPKTASPYASYP; ERIVAERNPRYW; GGFTPDKLGYYY; GFTPD KLGYYYT; FTPDKLGYYYTK (SEQ ID NOs: 1130-1144)

9mer: FLIIFELTF; STIKNGQKY; ITLESPKPY; YFIDMLVHQ; IPIHIAEKY; YVVEK NDKY; TTNDNSTAY; YSSAVNAIY; SAVNAIYFY; VNAIYFYAF; YFAFNTHI; RITPN FSSY; TPNFSSYSY; KTLLAEAGY; GFPILKLKY; FLSIFTQGY; IFTQGYTQF; YTQFS  A2902 TABLE A-8

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

SHNY; SHNYSSPEY; KDEPIAPIY; FPIAPIYIY; PIYIYGNSY; YIYGNSYLF; FLSIL
THGY; ILTHGYTQF; FLSIFTHGY; IFTHGYTQF; FSVIFELTF; TTNDSSTAY; IYFYA
ENTY; YFYAFNTYI; RIAPNESSY; APNESSYSY; NISPDGTVY; YFYAFNTTV; RATPN
FSSY; SHNYSNSEY; SLLFLIIFF; YVFEKNDKY; VFEKNDKYY; YFYAFNTKV; SVIKN
GQKY; YVFEKNNKY; VFEKNNKYY; SHNYSNPEY; KTASPYASY; IVAERNPRY; HTVIN
KVTY; DVSPQLATY; VSPQLATYY; SPQLATYYY; QLATYYYEF; GVTLKTPDY; FNASH
PLSF; HPLSENLLY; TMLDTMHTH; THNFDAVRY; VRYAWIADY; TSQYSNPDY; TTQER
GQFY; VPAIPVYHY; GFTPDKLGY; FTPDKLGYY; TPDKLGYYY; GYYYTKDMY; YYYTK
DMYI (SEQ ID NOs: 1145-1210)
10mer: LFLIIFFLTF; WDISPDGTVY; YVVEKNDKYY; YTTNDNSTAY; YSSAVNAIY;
YSSAVNAIYF; SSAVNAIYFY; AVNAIYFYAF; LAIDRETLTY; ITPNESSYSY; YSYA
KNLELF; NGFPILKLKY; YLNTKSNGNY; IARAGWIGDY; TELSIFTQGY; FLSIFTQGY
T; SIFTQGYTQF; GYTQFSSHNY; YTQFSSHNYS; SSHNYSSPEY; DEPIAPIYIY; API
YIYGNSY; IYIYGNSYLF; YIYGNSYLFR; TFLSILTHGY; FLSILTHGYT; TELSIFTH
GY; FLSIFTHGYT; SIFTHGYTQF; LESVIFFLTF; YTTNDSSTAY; NDSSTAYKMY;
AIYFYAFNTY; IYFYAFNTYI; YFYAFNTYIK; RRIAPNESSY; IAPNESSYSY; YLNTRSN
GNY; WNISPDGTVY; ATPNESSYSY; WDISSDGTVY; KYVFEKNDKY; YVFEKNDKYY;
LAIDRETLAY; YLNTKANGNY; KYVFEKNNKY; YVFEKNNKYY; YSYAKSLELF; SSHNYS
NPEY; LDVSPQLATY; DVSPQLATYY; VSPQLATYYY; PQLATYYYEF; YEENTTRPPE;
GFNASHPLSF; SHPLSENLLY; HTHNEDAVRY; AVRYAWIADY; NTSQYSNPDY; DVPAI
PVYHY; GGFTPDKLGY; GFTPDKLGYY; FTPDKLGYYY; LGYYYTKDMY; GYYYTKDMYI
(SEQ ID NOs: 1211-1275)
11mer: LLFLIIFFLTF; YFIDMLVHQSF; KYVVEKNDKYY; FYTTNDNSTAY; DYYSSA
VNAIY; YSSAVNAIYFY; RITPNFSSYSY; LTFLSIFTQGY; TELSIFTQGYT; QGYTQF
SSHNY; PIYIYGNSYLF; IYIYGNSYLFR; YIYGNSYLFRN; LTFLSILTHGY; HGYTQF
SSHNY; LTFLSIFTHGY; TELSIFTHGYT; LLESVIFFLTF; FYTTNDSSTAY; NAIYFY
AFNTY; AIYFYAFNTYI; RIAPNESSYSY; SLFLIIFELTF; ATELSIFTQGY; KYVFEK
NDKYY; YVFEKNDKYYN; TLAIDRETLAY; KYVFEKNNKYY; SYSAKSLELF; DVSPQL
ATYYY; ASHPLSENLLY; DAVRYAWIADY; GGFTPDKLGYY; GFTPDKLGYYY; KLGYYY
TKDMY (SEQ ID NOs: 1275-1310)
12mer: KLLFLIIFFLTF; PYFIDMLVHQSF; EKYVVEKNDKYY; TFYTTNDNSTAY; SD
YYSSAVNAIY; YSSAVNAIYFY; YSSAVNAIYFYA; LTLAIDRETLTY; RRITPNESSY
SY; PLTFLSIFTQGY; LTFLSIFTQGYT; TQGYTQFSSHNY; QFSSHNYSSPEY; IIEKD
FPIAPIY; APIYIYGNSYLF; PIYIYGNSYLFR; IYIYGNSYLERN; YIYGNSYLERND;
PLTFLSILTHGY; THGYTQFSSHNY; PLTELSIFTHGY; LTFLSIFTHGYT; KLLESVIF
FLTF; TFYTTNDSSTAY; VNAIYFYAENTY; NAIYFYAFNTYI; AIYFYAFNTYIK; RRI
APNESSYSY; KSLFLIIFELTF; NDYYSSAVNAIY; PATELSIFTQGY; ATFLSIFTQGY
T; QFSSHNYSNSEY; SLLFLIIFFLTF; EKYVFEKNDKYY; YVFEKNDKYYN; AFYTTN
DSSTAY; LTLAIDRETLAY; RSLFLIIFFLTF; EKYVFEKNNKYY; QFSSHNYSNPEY; L
DVSPQLATYYY; YYYEFNTTRPPF; NASHPLSENLLY; TMHTHNEDAVRY; FDAVRYAWI
ADY; WVGGFTPDKLGY; VGGFTPDKLGYY; GGFTPDKLGYYY; GFTPDKLGYYYT; DKLG
YYYTKDMY (SEQ ID NOs: 1311-1361)

9mer: LLFLIIFFL; GTVYTFTLR; KSYLRILNK; KSTIKNGQK; AVNAIYFYA; HIKPL   A3101
DNVK; KALTLAIDR; NESSYSYAK; KYNTSEAHK; PIKRQDILR; IYGNSYLFR; GWNTN  TABLE
ITER; LTFLSIFTH; LLESVIFFL; YFYAFNTYI; KSLELIIFF; SLFLIIFFL; KAKEG  A-9
VSFK; KSAIKNGQK; KYNTSDANK; GWNTNISER; IYFYAFNTK; KVRPLDNVK; RSLFL
IIFF; LTFLCCNNK; GTVYTENLR; KSVIKNGQK; KYVFEKNNK; KYNTNEANK; GWNTN
ILER; RTNFTLSLL; RLAEKWENK; NTVWTFHLR; HLVTSGAYK; LSQWVVNER; VNERI
VAER; RIVAERNPR; YYYEFNTTR; HTHNFDAVR; AATFLNNER; AIPVYHYVR; HYVRT
HLVK; YTKDMYIKK (SEQ ID NOs: 1362-1404)
10mer: KLLFLIIFFL; FELTFLCCNK; GSKMIDTMFK; DGTVYTFTLR; AEGIRKSYLR;
RKSYLRILNK; TSGPFKLKER; KLKERIPNEK; TTNDNSTAYK; AVNAIYFYAF; YFYA
FNTHIK; RKALTLAIDR; AIDRETLTYK; KYNTSEAHKS; KSNGNYEIAR; YIYGNSYLF
R; TGWNTNITER; REDLSQLKLK; KLLESVIFFL; GSKMIDTMER; TTNDSSTAYK; STA
YKMYENK; YFYAFNTYIK; RSNGNYEIAR; KSLFLIIFFL; FELTFLCCSK; ASKMIDTM
FR; YFYAFNTTVK; KYNTSDANKK; TGWNTNISER; SLLELIIFFL; AIYFYAFNTK; YF
YAFNTKVR; AIDRETLAYK; KANGNYEIAR; RSLFLIIFFL; TFLCCNNKER; DGTVYTF
NLR; TGWNTNILER; DNTVWTFHLR; NTVWTFHLRP; AQDVVWSWQR; KVLINRFGEK; K
LSQWVVNER; VVNERIVAER; ERIVAERNPR; ITSEAADVNR; TYYYEFNTTR; YYYEEN
TTRP; TTRPPENDVR; LYNTSESHQR; MHTHNEDAVR; DAATELNNER; AAKAKTTQER;
PAIPVYHYVR; YYYTKDMYIK (SEQ ID NOs: 1405-1460)
11mer: TAEGIRKSYLR; TKSNGNYEIAR; IYIYGNSYLFR; VGSKMIDTMER; IYFYAF
NTYIK; TRSNGNYEIAR; VASKMIDTMER; ASKMIDTMERG; SDGTVYTFTLR; IYFYAF
NTKVR; KVRPLDNVKVR; TKANGNYEIAR; LTFLCCNNKER; SDGTVYTENLR; KDNTVW
TFHLR; YKLSQWVVNER; WVVNERIVAER; ATYYYEENTTR; NTTRPPENDVR; RPPEND
VRVRK; LLYNTSESHQR; TMHTHNEDAVR (SEQ ID NOs: 1461-1482)
12mer: SPDGTVYTFTLR; ITAEGIRKSYLR; KVRKALTLAIDR; KVLDDGTTPTRR; NT
KSNGNYEIAR; PIYIYGNSYLFR; KWTGWNTNITER; NVGSKMIDTMER; AIYFYAENTY
IK; KVLDNGTTPTRR; NTRSNGNYEIAR; TRSNGNYEIARA; NVASKMIDTMER; VASKM
IDTMFRG; MVTSGPFKLKER; KWTGWNTNISER; SSDGTVYTFTLR; AIYFYAFNTKVR;
TKVRPLDNVKVR; KVRPLDNVKVRK; NTKANGNYEIAR; FLTFLCCNNKER; SSDGTVYT
FNLR; KIRKALTLAIDR; KSLELENPEIAK; KWTGWNTNILER; NKDNTVWTFHLR; KDN
TVWTFHLRP; ITAQDVVWSWQR; SMVPDKVLINR; AYKLSQWVVNER; QWVVNERIVAE
R; RYWDNAHTVINK; LATYYYEFNTTR; ATYYYEENTTRP; ENTTRPPENDVR; TTRPPE
NDVRVR; TRPPENDVRVRK; NLLYNTSESHQR; DTMHTHNEDAVR (SEQ ID NOs:

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

1483-1522)

| | |
|---|---|
| 9mer: KLQKLLFLI; KLLFLIIFF; FLIIFFLTF; IIFFLTFLC; IIWSDGVAI; KTLEI TLES; IDMLVHQSF; LVHQSFIPI; HQSFIPIPI; VNAIYFYAF; KILNIDVEL; IIIEK DFPI; YIYGNSYLF; KLQKLLFSV; QKLLESVIF; KLLESVIFF; KKEGISFKI; KLQKS LFLI; KSLFLIIFF; ITWSDGVAI; ELDAIFVSI; KNLNIDVEL; KSLLFLIIF; SLLFL IIFF; SSDGTVYTF; ITWSDGVPI; RIPNEKYVF; KLQRSLELI; RSLFLIIFF; YTENL REKI; HQSFIPVPV; KSLELENPE; RTNFTLSLL; TAQDVVWSW; KTASPYASY; SQWVV NERI; IDIVYTVPI; KTMGTQLDV; QLATYYYEF; SMWKKNLGV (SEQ ID NOs: 1523-1562)<br>10mer: MLVHQSFIPI; AVNAIYFYAF; KVRKALTLAI; SIFTQGYTQF; SIFTHGYTQF; KLQKLLESVI; KELDAIFVSI; KITWSDGVPI; KIRKALTLAI; KSLELENPEI; ITAQ DVVWSW; VINKVTYLPI; KTPDYASWPM (SEQ ID NOs: 1563-1575)<br>11mer: KLQKLLESVIF (SEQ ID NO: 1576)<br>12mer: KLLFLIIFFLTF; KLLESVIFELTE; KSLFLIIFELTE; RSLFLIIFELTE; KT MLDTMHTHNF (SEQ ID NOs: 1577-1581) | A3201 TABLE A-10 |
| 9mer: FLTFLCCNK; FLCCNKEEK; GTVYTFTLR; VAITAEGIR; EGIRKSYLR; GSNYS EMVK; LEITLESPK; NIVTSGPFK; VTSGPFKLK; TTNDNSTAY; TNDNSTAYK; SAIPP DLIK; DLIKDLKLR; YSSAVNAIY; SAVNAIYFY; NAIYFYAFN; FYAFNTHIK; HIKPL DNVK; NESSYSYAK; ELFNPEIAK; NGNGFPILK; NGFPILKLK; YNTSEAHKK; EFIQN QWKK; LTFLSIFTQ; YTQFSSHNY; YIYGNSYLF; NSYLERNDK; ERFDLSQLK; FLSIL THGY; LTFLSIFTH; FLSIFTHGY; SKMIDTMER; GSNYAEMVK; TTNDSSTAY; TNDSS TAYK; TAYKMYENK; GSIPPDLIK; FYAFNTYIK; YIKPLDNVK; EWTTYLNTR; FLTEL CCSK; LAEDNVASK; GSKYVEMVK; NMVTSGPFK; VSIPPDLIK; FYAFNTTVK; TVKPL DNVK; YNTSDANKK; NSEYNELIK; QAEEIIIEK; YVFEKNDKY; IYFYAFNTK; FYAFN TKVR; LTFLCCNNK; FLCCNNKER; GTVYTENLR; YVFEKNNKY; DLIKNLKLR; EPASL DPHK; EIQPRLAEK; NTVWTFHLR; QDVVWSWQR; NGAAIAQGK; HLVTSGAYK; LSQWV VNER; RIVAERNPR; DNAHTVINK; HTVINKVTY; TSEAADVNR; EAADVNRYK; DVSPQ LATY; YYYEFNTTR; YASWPMDKR; MDKRIAEAK; YNTSESHQR; AIAASSMWK; IAASS MWKK; HTHNEDAVR; AATFLNNER; DQALVNAAK; AIPVYHYVR; WVGGFTPDK; FTPDK LGYY; YTKDMYIKK (SEQ ID NOs: 1582-1666)<br>10mer: FFLTFLCCNK; GSKMIDTMFK; DGTVYTFTLR; TVYTFTLREK; GVAITAEGIR; VAITAEGIRK; TGSNYSEMVK; YSEMVKSTIK; QVSDSELGIR; ELGIRAIDEK; TLEI TLESPK; ENIVTSGPFK; IVTSGPFKLK; TSGPFKLKER; YTTNDNSTAY; TTNDNSTAY K; FSAIPPDLIK; YYSSAVNAIY; SSAVNAIYFY; YFYAFNTHIK; THIKPLDNVK; ITP NESSYSY; LELENPEIAK; YTQFSSHNYS; SSPEYNELIK; DPIKRQDILR; YIYGNSYL FR; TERFDLSQLK; GSKMIDTMER; TGSNYAEMVK; YAEMVKSTIK; YTTNDSSTAY; TT NDSSTAYK; STAYKMYENK; FGSIPPDLIK; YFYAFNTYIK; TYIKPLDNVK; EEWTTYL NTR; FELTFLCCSK; LTFLCCSKEK; EKAKEGVSFK; QLAEDNVASK; ASKMIDTMER; T GSKYVEMVK; YVEMVKSAIK; QVPDSEVGIR; EVGIRAIDEK; ENMVTSGPFK; MVTSGP FKLK; EVEVQEITFY; FVSIPPDLIK; YFYAFNTTVK; TTVKPLDNVK; SNSEYNELIK; NSEYNELIKK; YVFEKNDKYY; EVEVQEIAFY; AIYFYAFNTK; YFYAFNTKVR; ELTEL CCNNK; DGTVYTFNLR; TVYTENLREK; YVEMVKSVIK; QVTDSELGIR; YVFEKNNKYY; QLAEKQELVR; DNTVWTFHLR; NTVWTFHLRP; EHLVTSGAYK; KLSQWVVNER; VVNE RIVAER; ERIVAERNPR; ITSEAADVNR; SEAADVNRYK; EAADVNRYKA; YTVPINQFA Q; DVSPQLATYY; TYYYEFNTTR; TTRPPENDVR; DYASWPMDKR; YASWPMDKRI; IAI AASSMWK; AIAASSMWKK; EAKLQNQEWK; MHTHNEDAVR; HTHNEDAVRY; DAATELNN FR; NTSQYSNPDY; YDQALVNAAK; DVPAIPVYHY; PAIPVYHYVR; FTPDKLGYYY; YY YTKDMYIK; YYTKDMYIKK (SEQ ID NOs: 1667-1760)<br>11mer: PDGTVYTFTLR; GTVYTFTLREK; TAEGIRKSYLR; ETGSNYSEMVK; YTTNDN STAYK; IYIYGNSYLFR; YIYGNSYLERN; ITERFDLSQLK; YTTNDSSTAYK; NAIYFY AFNTY; IYFYAFNTYIK; NTYIKPLDNVK; VASKMIDTMER; ETGSKYVEMVK; NMVTSG PFKLK; SDGTVYTFTLR; NAIYFYAFNTK; LAIDRETLAYK; SDGTVYTENLR; GTVYTF NLREK; KDNTVWTFHLR; TAQDVVWSWQR; WVVNERIVAER; TSEAADVNRYK; ATYYYE FNTTR; NTTRPPENDVR; TMHTHNFDAVR; DDAATELNNER; DAATELNNERT (SEQ ID NOs: 1761-1789)<br>12mer: IIFFLTFLCCNK; NVGSKMIDTMFK; SPDGTVYTFTLR; DGTVYTFTLREK; IT AEGIRKSYLR; FYTTNDNSTAYK; ITPNESSYSYAK; NTKSNGNYEIAR; PIYIYGNSYL FR; IYIYGNSYLFRN; NITERFDLSQLK; VIFFLTFLCCNK; NVGSKMIDTMER; FYTTN DSSTAYK; VNAIYFYAFNTY; AIYFYAFNTYIK; FNTYIKPLDNVK; IIFFLTFLCCSK; NVASKMIDTMER; KETGSKYVEMVK; ENMVTSGPFKLK; MVTSGPFKLKER; NISERFDL SQLK; SSDGTVYTFTLR; VNAIYFYAFNTK; NAIYFYAFNTKVR; TLA IDRETLAYK; NTKANGNYEIAR; FLTFLCCNNKER; SSDGTVYTENLR; DGTVYTENLRE K; NILERFDLSQLK; NKDNTVWTFHLR; ITAQDVVWSWQR; QWVVNERIVAER; ITSEAA DVNRYK; YTVPINQ FAQLK; LATYYYEFNTTR; ENTTRPPENDVR; TPDYASWPMDKR; D TMHTHNEDAVR; YDDAATELNNER; DVPAIPVYHYVR; FTPDKLGYYYTK (SEQ ID NOs: 1790-1834) | A6801 TABLE A-11 |
| 9mer: SPDGTVYTF; SPKPYFIDM; KPYFIDMLV; NPEIAKTLL; YPNGNGFPI; QPNAA FLAM; LAMLAHPSM; NPRYWDNAH; VPINQFAQL; RVRKALNMA; QPDIGGVTL; TPDYA SWPM; WPMDKRIAE; RIAIAASSM (SEQ ID NOs: 1835-1848)<br>10mer: KPGLAKSWDI; SPKPYFIDML; KVRKALTLAI; TPTRRITPNF; ENPEIAKTLL; GYPNGNGFPI; YPNGNGFPIL; ADPLTELSIL; TPTRRIAPNF; RPGLAKSWNI; TPTR RATPNF; ADPATELSIF; RPGLAKSWDI; KPGLAKGWDI; KIRKALTLAI; SPTGEIQPR L; SPYASYPGNM; APDTLGVKAL; TQPNAAFLAM; QPNAAFLAML; KPEHLVTSGA; RNP | B0702 TABLE A-12 |

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

RYWDNAH; NPRYWDNAHT; LPITSEAADV; TVPINQFAQL; RVRKALNMAL; SQPDIGGV
TL; KTPDYASWPM; SWPMDKRIAE; WPMDKRIAEA; VPAIPVYHYV (SEQ ID NOs:
1849-1879)
11mer: SPDGTVYTFTL; AGYPNGNGFPI; GYPNGNGFPIL; YPNGNGFPILK; APIYIY
GNSYL; SPENIVTSGPF; SPENMVTSGPF; LTQPNAAFLAM; TQPNAAFLAML; NPRYWD
NAHTV; VRVRKALNMAL; RVRKALNMALD; RPAWLISQPDI; SWPMDKRIAEA; WPMDKR
IAEAK; IPVYHYVRTHL (SEQ ID NOs: 1880-1895)
12mer: KPLDNVKVRKAL; AGYPNGNGFPIL; YPNGNGFPILKL; TSPENMVTSGPF; SP
ENMVTSGPFK; RPLDNVKVRKAL; KPLDNVKIRKAL; RPGITWSDGTAI; TLTQPNAAFL
AM; LTQPNAAFLAML; NPRYWDNAHTVI; DVRVRKALNMAL; VRVRKALNMALD; RVRKA
LNMALDK; KPWVGGFTPDKL (SEQ ID NOs: 1896-1910)

9mer: MKLQKLLFL; FLIIFFLTF; SPKPYFIDM; VNAIYFYAF; ILKLKYNTS; EAHKK        B0801
ICEF; LIKKSDLEL; MKLQKSLFL; MKLQKSLLF; MKLQRSLFL; YSYAKSLEL; EANKK        TABLE
ICEF; LAMLAHPSM; VPINQFAQL; QLATYYYEF; WPMDKRIAE; FNASHPLSF; SMWKK        A-13
NLGV (SEQ ID NOs: 1911-1928)
10mer: FLIIFFLTFL; ESPKPYFIDM; SPKPYFIDML; FIDMLVHQSF; MLVHQSFIPI;
YAFNTHIKPL; NVKVRKALTL; ELIKKSDLEL; YAFNTYIKPL; MKLQKSLLEL; YAEN
TKVRPL; NVKIRKALTL; QSRTNFTLSL; FLAMLAHPSM; WPMDKRIAEA
11mer: FYAFNTHIKPL; DNVKVRKALTL; DNVKIRKALTL; SWPMDKRIAEA
12mer: YFYAFNTHIKPL; LDNVKVRKALTL; YFYAFNTKVRPL; NLKLRSDYYSSA; LD
NVKIRKALTL; ASWPMDKRIAEA (SEQ ID NOs: 1929-1943)

9mer: MKLQKLLFL; LQKLLFLII; QKLLFLIIF; KLLFLIIFF; FLIIFELTE; EEKKE        B1503
GVSF; GSKMIDTMF; TMEKGLITG; YTFTLREKI; IIWSDGVAI; IRKSYLRIL; LNKET        TABLE
GSNY; STIKNGQKY; GQKYFDGQV; QKYFDGQVS; ITLESPKPY; TLESPKPYF; IDMLV        A-14
HQSF; DMLVHQSFI; LVHQSFIPI; HQSFIPIPI; IAEKYGQSW; QSWTNPENI; ENIVT
SGPF; FKLKERIPN; KERIPNEKY; DKYYNSNQV; KYYNSNQVE; VEVQEITFY; TTNDN
STAY; YKMYENGEL; KMYENGELD; LKLRSDYYS; KLRSDYYSS; LRSDYYSSA; RSDYY
SSAV; YSSAVNAIY; SSAVNAIYF; SAVNAIYFY; VNAIYFYAF; YFYAFNTHI; VKVRK
ALTL; VRKALTLAI; PTRRITPNF; RITPNESSY; FSSYSYAKN; SSYSYAKNL; YSYAK
NLEL; KTLLAEAGY; AGYPNGNGF; LKLKYNTSE; KLKYNTSEA; LKYNTSEAH; EAHKK
ICEF; NQWKKILNI; LENEEWTTY; LNTKSNGNY; TKSNGNYEI; GDYADPLTF; FLSIE
TQGY; QGYTQFSSH; YTQFSSHNY; TQFSSHNYS; SSHNYSSPE; SHNYSSPEY; YSSPE
YNEL; KDEPIAPIY; FPIAPIYIY; PIYIYGNSY; YIYGNSYLF; LTFLSILTH; FLSIL
THGY; ILTHGYTQF; HGYTQFSSH; LTFLSIFTH; FLSIFTHGY; IFTHGYTQF; LQKLL
FSVI; QKLLESVIF; KLLESVIFF; LLESVIFFL; FSVIFELTF; EEKKEGISF; QSWTS
PENI; TTNDSSTAY; YKMYENKEL; IYFYAFNTY; YFYAFNTYI; PTRRIAPNE; RIAPN
FSSY; APNESSYSY; LNTRSNGNY; MKLQKSLFL; KLQKSLFLI; LQKSLFLII; QKSLE
LIIF; KSLFLIIFF; EKAKEGVSF; ASKMIDTMF; NISPDGTVY; ITWSDGVAI; LNKET
GSKY; SAIKNGQKY; AIKNGQKYF; GQKYFDEQV; QSWTSPENM; ENMVTSGPF; DKYYN
SNEV; KLRNDYYSS; RNDYYSSAV; YFYAFNTTV; PTRRATPNF; RATPNESSY; LKLKY
NTSD; LKYNTSDAN; NQWKKNLNI; GDYADPATF; SHNYSNSEY; YSNSEYNEL; MKLQK
SLLF; KLQKSLLEL; LQKSLLFLI; QKSLLELII; KSLLFLIIF; SLLFLIIFF; SSDGT
VYTF; ITWSDGVPI; RIPNEKYVF; YVFEKNDKY; DKYYNSSEV; VEVQEIAFY; YKMYE
NEEL; AIDRETLAY; TKANGNYEI; MKLQRSLEL; LQRSLFLII; QRSLELIIF; RSLEL
IIFF; KERKEGVSF; YTENLREKI; SVIKNGQKY; VIKNGQKYF; QKYFDGQVT; LVHQS
FIPV; HQSFIPVPV; QSFIPVPVH; QNWTSPENM; YVFEKNNKY; NKYYDSNEV; VELEE
ITFY; KNLKLRSDY; IKPLDNVKI; VKIRKALTL; IRKALTLAI; FSSYSYAKS; SSYSY
AKSL; YSYAKSLEL; SYAKSLELF; LKYNTNEAN; EANKKICEF; SHNYSNPEY; YSNPE
YNEL; MKSQSRTNF; SQSRTNFTL; SRTNFTLSL; TQLAEKQEL; HKVESDVEF; NKDNT
VWTF; FHLRPGITW; ITWSDGTAI; VDPKTASPY; KTASPYASY; YASYPGNMH; ASYPG
NMHI; MHIVNGAAI; KQAPDTLGV; VKALNDTTL; TLTQPNAAF; LTQPNAAFL; LAMLA
HPSM; AMLAHPSMV; LAHPSMVPV; SMVPVDKVL; EKWTKPEHL; EHLVTSGAY; YKLSQ
WVVN; SQWVVNERI; HTVINKVTY; INKVTYLPI; KAGEIDIVY; VYTVPINQF; LKKTM
GTQL; TQLDVSPQL; VSPQLATYY; QLATYYYEF; VRKALNMAL; LKTPDYASW; KKLLE
EAGF; AGFNASHPL; FNASHPLSF; LLYNTSESH; RIAIAASSM; SMWKKNLGV; LQNQE
WKTM; TMLDTMHTH; LDTMHTHNF; MHTHNEDAV; VRYAWIADY; ADYDDAATE; TSQYS
NPDY; SQYSNPDYD; KTTQERGQF; TTQERGQFY; RDVPAIPVY; LGYYYTKDM; GYYYT
KDMY; YYYTKDMYI (SEQ ID NOs: 1944-2170)
10mer: LQKLLFLIIF; LFLIIFFLTF; KSTIKNGQKY; RRITPNESSY; YSYAKNLELF;
SSHNYSSPEY; SIFTHGYTQF; LQKLLESVIF; QKLLESVIFF; LESVIFELTE; FSVI
FELTFL; RRIAPNESSY; LQKSLFLIIF; KEKAKEGVSF; KSAIKNGQKY; SAIKNGQKY
F; RRATPNESSY; SSHNYSNSEY; QKSLLFLIIF; LQRSLELIIF; NKERKEGVSF; KSV
IKNGQKY; YSYAKSLELF; SSHNYSNPEY; PKTASPYASY; PQLATYYYEF; YEFNTTRP
PF; IADYDDAATF (SEQ ID NOs: 2171-2198)
11mer: LQKLLELIIFF; LLFLIIFFLTF; KLQKSLFLIIF; LQKSLFLIIFF; LLESVI
FFLTF; KLQKSLLFLII; LQKSLLFLIIF; SKEKAKEGVSF; LQKSLLFLIIF; KLQRSL
FLIIF; LQRSLELIIFF; YYEFNTTRPPF (SEQ ID NOs: 2199-2210)
12mer: KMYENGELDAIF; MKLQKLLESVIF; KLQKLLESVIFF; LQKLLESVIFFL; KL
LESVIFFLTF; LLESVIFFLTEL; KMYENKELDAIF; MKLQKSLFLIIF; KLQKSLELII
FF; LQKSLFLIIFFL; KSWNISPDGTVY; KLQKSLLFLIIF; LQKSLLFLIIFF; KSWDI
SSDGTVY; KMYENEELDAIF; MKLQRSLELIIF; KLQRSLELIIFF; LQRSLFLIIFFL;
RSLFLIIFFLTF; SSYSYAKSLELF; YYYEFNTTRPPF; SQYSNPDYDQAL; AKAKTTQE
RGQF (SEQ ID NOs: 2211-2233)

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

9mer: EEKKEGVSF; DEKTLEITL; IDMLVHQSF; VEVQEITFY; GELDAIFSA; TPNES SYSY; LENEEWTTY; NEEWTTYLN; DPLTELSIF; EEKKEGISF; IYFYAENTY; DPATF LSIF; VEVQEIAFY; YENEELDAI; EELDAIFGS; KERKEGVSF; VELEEITFY; VEFNI LSDL; WENKDNTVW; GEIDIVYTV; YEFNTTRPP; EEAGENASH (SEQ ID NOs: 2234-2255)
10mer: YENGELDAIF; NGELDAIFSA; ELENEEWTTY; YENKELDAIF; NEVEVQEITE; SEVEVQEIAF; YENEELDAIF; NEVELEEITF; EVELEEITFY; VEFNILSDLE; YEFN TTRPPF; QEWKTMLDTM (SEQ ID NOs: 2256-2267)
11mer: LEITLESPKPY; MYENGELDAIF; YENGELDAIFS; VELENEEWTTY; IEKDEP IAPIY; MYENKELDAIF; YENKELDAIFG; SNEVEVQEITF; NEVEVQEITFY; YENKEL DAIFV; SSEVEVQEIAF; SEVEVQEIAFY; MYENEELDAIF; YENEELDAIFG; SNEVEL EEITF; NEVELEEITFY; WENKDNTVWTF; YYEFNTTRPPF; YEENTTRPPEN (SEQ ID NOs: 2268-2286)
12mer: TLEITLESPKPY; KMYENGELDAIF; YENGELDAIFSA; DVELENEEWTTY; II EKDEPIAPIY; IEKDEPIAPIYI; KMYENKELDAIF; NSNEVEVQEITE; SNEVEVQEIT FY; NEVEVQEITFYT; NSSEVEVQEIAF; SSEVEVQEIAFY; KMYENEELDAIF; MYENE ELDAIFG; DSNEVELEEITF; SNEVELEEITFY; NEVELEEITFYT; KWENKDNTVWTF; WENKDNTVWTFH; LEVTLTQPNAAF; YYYEFNTTRPPF; YYEFNTTRPPEN; YEFNTTRP PEND (SEQ ID NOs: 2287-2309)

B1801 TABLE A-15

9mer: FLIIFFLTF; EPSSLDPQL; DISPDGTVY; SPDGTVYTF; TAEGIRKSY; ITLES PKPY; SPKPYFIDM; IPIPIHIAE; IPIHIAEKY; YVVEKNDKY; QVEVQEITF; TTNDN STAY; YSSAVNAIY; SAVNAIYFY; RITPNESSY; TPNFSSYSY; YPNGNGFPI; EAHKK ICEF; LENEEWTTY; YADPLTELS; DPLTELSIF; FLSIFTQGY; YTQFSSHNY; FPIAP IYIY; YIYGNSYLF; FLSILTHGY; FLSIFTHGY; TTNDSSTAY; IYFYA ENTY; RIAPNESSY; APNESSYSY; VASKMIDTM; NISPDGTVY; SAIKNGQKY; IPIPI HVTE; IPIHVTEKY; MVTSGPFKL; EVEVQEITF; RATPNESSY; YADPATELS; DPATE LSIF; YSNSEYNEL; DISSDGTVY; SSDGTVYTF; YVFEKNDKY; EVEVQEIAF; AIDRE TLAY; IPVPVHVTE; VPVHVTEKY; YVFEKNNKY; EVELEEITF; YSYAKSLEL; EANKK ICEF; YSNPEYNEL; CASAASQAA; VPAGTQLAE; HKVESDVEF; YASYPGNMH; YPGNM HIVN; TLTQPNAAF; QPNAAFLAM; AAFLAMLAH; LAMLAHPSM; LAHPSMVPV; IVAER NPRY; NPRYWDNAH; HTVINKVTY; LPITSEAAD; KAGEIDIVY; VPINQFAQL; DVSPQ LATY; SPQLATYYY; MALDKDIIA; QPDIGGVTL; TPDYASWPM; WPMDKRIAE; FNASH PLSF; HPLSENLLY; IAIAASSMW; WIADYDDAA; IADYDDAAT; DAATFLNNF; VPAIP VYHY; TPDKLGYYY (SEQ ID NOs: 2310-2394)
10mer: ISPDGTVYTF; FIPIPIHIAE; YTTNDNSTAY; YSSAVNAIY; YAFNTHIKPL; LAIDRETLTY; ITPNESSYSY; TPNFSSYSYA; YPNGNGFPIL; DEPIAPIYIY; FPIA PIYIYG; APIYIYGNSY; YTTNDSSTAY; YAFNTYIKPL; APNESSYSY A; YAFNTTVKPL; ATPNFSSYSY; WDISSDGTVY; YVFEKNDKYY; LAIDRETLAY; LVD PKTASPY; TQPNAAFLAM; QPNAAFLAML; FLAMLAHPSM; YKAGEIDIVY; VSPQLATY YY; KTPDYASWPM; TPDYASWPMD; SHPLSENLLY; HPLSENLLYN; IADYDDAATE; FT PDKLGYYY (SEQ ID NOs: 2395-2427)
11mer: IPIPIHIAEKY; FYTTNDNSTAY; TLAIDRETLTY; LAIDRETLTYK; RITPNE SSYSY; ITPNESSYSYA; YADPLTELSIF; KDEPIAPIYIY; FPIAPIYIYGN; FYTTND SSTAY; RIAPNESSYSY; IAPNESSYSYA; IPIPIHVTEKY; RATPNESSYSY; YADPAT FLSIF; TLAIDRETLAY; LAIDRETLAYK; IPVPVHVTEKY; LTQPNAAFLAM; LKTPDY ASWPM (SEQ ID NOs: 2428-2447)
12mer: WDISPDGTVYTF; FIPIPIHIAEKY; IPIPIHIAEKYG; RRITPNESSYSY; IT PNFSSYSYAK; YPNGNGFPILKL; EKDEPIAPIYIY; FPIAPIYIYGNS; RRIAPNESSY SY; IAPNESSYSYAK; WNISPDGTVYTF; FIPIPIHVTEKY; IPIPIHVTEKYG; LTLAI DRETLAY; TLAIDRETLAYK; LAIDRETLAYKV; FIPVPVHVTEKY; IPVPVHVTEKYG; TLTQPNAAFLAM; LTQPNAAFLAML; LDVSPQLATYYY; TLKTPDYASWPM; LKTPDYAS WPMD (SEQ ID NOs: 2448-2470)

B3501 TABLE A-16

9mer: REKIIWSDG; AEGIRKSYL; KETGSNYSE; LESPKPYFI; YENGELDAI; GELDA IFSA; RETLTYKVL; YEIARAGWI; TERFDLSQL; KETGSNYAE; YENKELDAI; KELDA IFGS; SLFLIIFFL; KELDAIFVS; SERFDLSQL; SEVEVQEIA; QEIAFYTTN; YENEE LDAI; RETLAYKVL; KERKEGVSF; LEEITFYTT; LERFDLSQL; VESDVEFNI; VEFNI LSDL; FEGLVNVSP; GEIDIVYTV; YEFNTTRPP; SESHQRIAI; QEWKTMLDT; SENTS QYSN; YDQALVNAA; AEDLLGRDV (SEQ ID NOs: 2471-2502)
10mer: KEGVSFKISL; AEPSSLDPQL; REKIIWSDGV; KETGSNYSEM; AEKYGQSWTN; VEVQEITFYT; MYENGELDAI; YENGELDAIF; NGELDAIFSA; GELDAIFSAI; DRET LTYKVL; RETLTYKVLD; SEAHKKICEF; LENEEWTTYL; KEGISFKISL; SEPSSLDPQ L; KETGSNYAEM; AEKYGQSWTS; MYENKELDAI; YENKELDAIF; KELDAIFGSI; KEK AKEGVSF; KETGSKYVEM; TEKYGQSWTS; KELDAIFVSI; VEVQEIAFYT; MYENEELD AI; YENEELDAIF; EELDAIFGSI; DRETLAYKVL; RETLAYKVLD; RSLFLIIFFL; VE LEEITFYT; KVESDVEFNI; VESDVEFNIL; DVEFNILSDL; VEFNILSDLE; FEGLVNV SPT; AGEIDIVYTV; GEIDIVYTVP; YEFNTTRPPF; AEAKKLLEEA; TSESHQRIAI; S ESHQRIAIA; QEWKTMLDTM; QERGQFYQQA (SEQ ID NOs: 2503-2548)
11mer: KETGSNYSEMV; NGELDAIFSAI; GELDAIFSAIP; KETGSNYAEMV; NKELDA IFGSI; KELDAIFGSIP; NKELDAIFVSI; KELDAIFVSIP; SDVEFNILSDL; KAGEID IVYTV; AGEIDIVYTVP; GEIDIVYTVPI; YYEFNTTRPPF; YEFNTTRPPEN; NQEWKT MLDTM; QEWKTMLDTMH (SEQ ID NOs: 2549-2564)
12mer: REKIIWSDGVAI; NKETGSNYSEMV; YENGELDAIFSA; ENGELDAIFSAI; NG ELDAIFSAIPP; GELDAIFSAIPP; AEEIIIEKDEPI; ENKELDAIFGSI; NKELDAIFGS IP; KELDAIFGSIPP; ENKELDAIFVSI; NKELDAIFVSIP; KELDAIFVSIPP; REKIT

B4002 TABLE A-17

TABLE A-continued

Predicted MHC class 1 binding peptides P derived from Borrelia antigen OppA (8-, 9-, 10-, 11-, and 12-mers), predicted as detailed in Example 17. The binding peptides P are sorted per HLA-allele.

WSDGVPI; ESDVEFNILSDL; SDVEFNILSDLF; YKAGEIDIVYTV; KAGEIDIVYTVP; AGEIDIVYTVPI; GEIDIVYTVPIN; YYYEFNTTRPPF; YEFNTTRPPEND; LEEAGENA SHPL; QNQEWKTMLDTM; NQEWKTMLDTMH; QEWKTMLDTMHT (SEQ ID NOs: 2565-2590)

| | |
|---|---|
| 9mer: EEKKEGVSF; AEGIRKSYL; IDMLVHQSF; KERIPNEKY; VEVQEITFY; LENEE WTTY; YEIARAGWI; EEIIIEKDE; EEKKEGISF; AEDNVASKM; VEVQEIAFY; KERKE GVSF; VELEEITFY; WENKDNTVW; TAQDVVWSW; SEAADVNRY; GEIDIVYTV; SESHQ RIAI; ADYDDAATF; SENTSQYSN; AEDLLGRDV (SEQ ID NOs: 2591-2611) 10mer: KEEKKEGVSF; AEPSSLDPQL; KETGSNYSEM; FIDMLVHQSF; QVEVQEITFY; YENGELDAIF; GELDAIFSAI; SEAHKKICEF; ELENEEWTTY; NYEIARAGWI; AEEI IIEKDE; KEEKKEGISF; KEGISFKISL; KETGSNYAEM; AEMVKSTIKN; MYENKELDA I; YENKELDAIF; KEKAKEGVSF; AEDNVASKMI; NEVEVQEITF; EVEVQEITFY; KEL DAIFVSI; SEVEVQEIAF; EVEVQEIAFY; MYENEELDAI; YENEELDAIF; NKERKEGV SF; NEVELEEITF; EVELEEITFY; NEANKKICEF; VEFNILSDLF; KWENKDNTVW; TS EAADVNRY; SEAADVNRYK; AGEIDIVYTV; YEFNTTRPPF; VEAKLQNQEW; QEWKTML DTM (SEQ ID NOs: 2612-2649) 11mer: AEAGYPNGNGF; SEVEVQEIAFY; GEIQPRLAEKW; WENKDNTVWTF; GVEAKL QNQEW; VEAKLQNQEWK (SEQ ID NOs: 2650-2655) 12mer: TGEIQPRLAEKW; GEIQPRLAEKWE; AEKWENKDNTVW; AEAKKLLEEAGF; VE AKLQNQEWKT; SENTSQYSNPDY (SEQ ID NOs: 2656-2661) | B4402 TABLE A-18 |
| 9mer: AEKYGQSWT; QEITFYTTN; GELDAIFSA; EEWTTYLNT; AEMVKSTIK; TEKYG QSWT; KELDAIFVS; SEVEVQEIA; QEIAFYTTN; TEKYGQNWT; LEEITFYTT; EEITE YTTN; GEIDIVYTV; LEEAGENAS; EEAGENASH; SESHQRIAI; QEWKTMLDT; AEDLL GRDV (SEQ ID NOs: 2662-2679) 10mer: NGELDAIFSA; GELDAIFSAI; NPEIAKTLLA; NEEWTTYLNT; AEKYGQSWTS; KELDAIFVSI; SSEVEVQEIA; QEIAFYTTND; EELDAIFGSI; ELEEITFYTT; SLEL FNPEIA; LEVTLTQPNA; KPEHLVTSGA; AGEIDIVYTV; AEAKKLLEEA; SESHQRIAI A; QERGQFYQQA (SEQ ID NOs: 2680-2696) 11mer: REKIIWSDGVA; REKITWSDGVA; EEWTTYLNTKA; AERNPRYWDNA; SEAADV NRYKA; IAEAKKLLEEA; AEAKKLLEEAG; TSESHQRIAIA; SESHQRIAIAA; TQERGQ FYQQA; QERGQFYQQAE; AEDLLGRDVPA (SEQ ID NOs: 2697-2708) 12mer: LREKIIWSDGVA; EEIIIEKDEPIA; LREKITWSDGVA; QEIAFYTTNDSS; NE EWTTYLNTKA; EEWTTYLNTKAN; VAERNPRYWDNA; AERNPRYWDNAH; TSEAADVNRY KA; SEAADVNRYKAG; RIAEAKKLLEEA; IAEAKKLLEEAG; AEAKKLLEEAGF; TSESH QRIAIAA; SESHQRIAIAAS; TTQERGQFYQQA; TQERGQFYQQAE; QERGQFYQQAED; QAEDLLGRDVPA; AEDLLGRDVPAI (SEQ ID NOs: 2709-2728) | B4501 TABLE A-19 |
| 9mer: LAHPSMVPV; VPINQFAQL (SEQ ID NOs: 2729-2730) 10mer: VPAIPVYHYV (SEQ ID NO: 2731) | B5101 TABLE A-20 |

Preferred binding peptides P derived or predicted from *Borrelia* protein DbpA capable of interacting with one or more MHC class 1 molecules are listed in Table B:

TABLE B

Predicted MHC class 1 binding peptides P derived from Borrelia antigen DbpA (8-, 9-, 10-, 11-, and 12-mers), predicted as detailed in Example 18. The binding peptides P are sorted per HLA-allele.

DbpA antigenic polypeptide sequences

BORRELIA AFZELLI.PKO (SEQ ID NO: 10)

BORRELIA AFZELLI.ACA-1 (SEQ ID NO: 11)

BORRELIA AFZELLI.A91 (SEQ ID NO: 12)

BORRELIA AFZELLI.U01 (SEQ ID NO: 13)

BORRELIA GARINII.PBI (SEQ ID NO: 14)

BORRELIA GARINII.PREF (SEQ ID NO: 15)

BORRELIA GARINII.VS461 (SEQ ID NO: 16)

BORRELIA GARINII.S40 (SEQ ID NO: 17)

BORRELIA BURGDORFERI.B31 (SEQ ID NO: 18)

TABLE B-continued

Predicted MHC class 1 binding peptides P derived from Borrelia antigen DbpA (8-, 9-, 10-, 11-, and 12-mers), predicted as detailed in Example 18. The binding peptides P are sorted per HLA-allele.

BORRELIA BURGDORFERI.PMAI (SEQ ID NO: 19)

BORRELIA BURGDORFERI.CA-11.2A (SEQ ID NO: 20)

| Predicted DbpA antigenic peptides P | HLA-allele |
|---|---|
| 9mer: FTDKQTGSK; SSGAFSAMY; FSGIYDLIY; FTDKQTGSK; SSGAFSAMY; SSGEF SAMY; FSAMYDLMF; FTDQKTGAK; FTDSATGGK; SSGEFSAMY; FSAMYDLMF (SEQ ID NOs: 2732-2742)<br>10mer: FTDKQTGSKV; GSSGAFSAMY; EFSGIYDLIY; FSGIYDLIYR; FTDKQTGSKV; GSSGAFSAMY; GSSGEFSAMY; FTDSATGGKV; GSSGEFSAMY (SEQ ID NOs: 2743-2748)<br>11mer: DEFSGIYDLIY (SEQ ID NO: 2752)<br><br>12mer: EDEFSGIYDLIY; ETGSSGEFSAMY (SEQ ID NOs: 2753-2754) | A0101 TABLE B-1 |
| 9mer: KIILTLTLL; IILTLTLLA; LTLTLLASL; TLLASLLAA; LLASLLAAC; SLLAA CSLT; GIYDLILNA; GMKDMTKTV; TTANGIIEI; GMQGMKQAV; TTADGIIAI; NLIKL SLIV; KLSLIVSLL; SLIVSLLVA; KLESSAQEI; FILKAKIQA; FSAMYDLML; AMYDL MLDV; LMLDVSKPL; KMTGTVTQA; TTAEGILAI; AMEDKLNNV; NLLKLTLIV; KLTLI VGLL; TLIVGLLVA; FLKEIEEEA; QLLKDMYDL; DMYDLMLNA; LMLNAAGSL; GLQEM IKTV; TTVEGILMI; NLLKLSLIV; KVSEKPEFI; KMTGTVTQV; AMEDKLKNV; KIILT LTLL; IILTLTLLA; LTLTLLASL; TLLASLLAA; LLASLLAAC; SLLAACSLT; GIYDL IYRT; LIYRTAEAV; TTANGIIAI; NLLKLSLIV; KLSLIVSLL; SLIVSLLVA; KVSEK PEFI; FSAMYDLML; AMYDLMLDV; LMLDVSKPL; TTAEGILAI; AMEEKLNNV; KTENN LLKL; NLLKLTILV; KLTILVNLL; ILVNLLISC; LISCGLTGA; GVSENPFIL; FILEA KVRA; FVIAIEEEA; AMYDLMFEV; LMFEVSKPL; KMREKLQRV; IIALTLQFL; FLKET KEEA; ELYELMLKI; LMLKISKAV; GIQNMTATV; MTATVSMGI; KTENNLLKL; NLLKL TILV; KLTILVNLL; ILVNLLISC; LISCGLTGA; AIVDEIDAI; FLTAIEEEA; AMYDL MFEV; LMFEVSKPL; GIQDMTKEV; KMREKLIRV (SEQ ID NOs: 2755-2835)<br>10mer: KIILTLTLLA; ILTLTLLASL; LTLLASLLAA; TLLASLLAAC; RVADLTIKEL; FLEATEEETI; SGIYDLILNA; GIYDLILNAA; TTADGIIAIV; KNLIKLSLIV; LIKL SLIVSL; IKLSLIVSLL; KLSLIVSLLV; FILKAKIQAI; SAMYDLMLDV; AMYDLMLDV S; DLMLDVSKPL; LMLDVSKPLE; KAMEDKLNNV; KNLLKLTLIV; NLLKLTLIVG; LLK LTLIVGL; KLTLIVGLLV; QLLKDMYDLM; LLKDMYDLML; KDMYDLMLNA; LGLQEMIK TV; KNLLKLSLIV; LLKLSLIVSL; LKLSLIVSLL; QKMTGTVTQV; KIILTLTLLA; IL TLTLLASL; LTLLASLLAA; TLLASLLAAC; LVADLTIEFL; FLKATEEETI; GIYDLIY RTA; YDLIYRTAEA; KNLLKLSLIV; LLKLSLIVSL; LKLSLIVSLL; KLSLIVSLLV; S AMYDLMLDV; AMYDLMLDVS; DLMLDVSKPL; LMLDVSKPLE; QAMEEKLNNV; NNLLKL TILV; NLLKLTILVN; LLKLTILVNL; KLTILVNLLI; LLISCGLTGA; TVAEKFVIAI; SAMYDLMFEV; AMYDLMFEVS; DLMFEVSKPL; LMFEVSKPLQ; RIIALTLQFL; KELYE LMLKI; YELMLKISKA; ELMLKISKAV; NMTATVSMGI; MTATVSMGIV; NNLLKLTILV; NLLKLTILVN; LLKLTILVNL; KLTILVNLLI; LLISCGLTGA; KELTAIEEEA; SAMY DLMFEV; AMYDLMFEVS; DLMFEVSKPL; LMFEVSKPLQ; KKMREKLIRV (SEQ ID NOs: 2836-2910)<br>11mer: IILTLTLLASL; LLASLLAACSL; FSGIYDLILNA; NLIKLSLIVSL; IKLSLI VSLLV; FSAMYDLMLDV; SAMYDLMLDVS; YDLMLDVSKPL; IKNLLKLTLIV; NLLKLT LIVGL; FLKEIEEEANI; LKDMYDLMLNA; LMIANTIEDKL; KKNLLKLSLIV; NLLKLS LIVSL; LKLSLIVSLLV; IILTLTLLASL; LLASLLAACSL; KLVADLTIEFL; KKNLLK LSLIV; NLLKLSLIVSL; KLSLIVSLLV; SAMYDLMLDVS; SAMYDLMLDVS; YDLMLD VSKPL; FNNLLKLTILV; NLLKLTILVNL; ILVNLLISCGL; FSAMYDLMFEV; SAMYDL MFEVS; AMYDLMFEVSK; YDLMFEVSKPL; FKELYELMLKI; ENNLLKLTILV; NLLKLT ILVNL; ILVNLLISCGL; FSAMYDLMFEV; SAMYDLMFEVS; AMYDLMFEVSK; YDLMFE VSKPL (SEQ ID NOs: 2911-2950)<br>12mer: KIILTLTLLASL; TLLASLLAACSL; EFSGIYDLILNA; DESGIYDLILNA; AF SAMYDLMLDV; FSAMYDLMLDVS; MYDLMLDVSKPL; LMLDVSKPLEEI; YIKNLLKLTL IV; KNLLKLTLIVGL; LLKDMYDLMLNA; KNLLKLSLIVSL; LLKLSLIVSLLV; KIILT LTLLASL; TLLASLLAACSL; KKLVADLTIEFL; KNLLKLSLIVSL; LLKLSLIVSLLV; AFSAMYDLMLDV; FSAMYDLMLDVS; MYDLMLDVSKPL; LMLDVSKPLEEI; TENNLLK TILV; FNNLLKLTILVN; NNLLKLTILVNL; TILVNLLISCGL; FILEAKVRATTV; EFS AMYDLMFEV; FSAMYDLMFEVS; SAMYDLMFEVSK; AMYDLMFEVSKP; MYDLMFEVSKP L; YDLMFEVSKPLQ; LMFEVSKPLQKL; EFKELYELMLKI; FKELYELMLKIS; TENNLL KLTILV; FNNLLKLTILVN; NNLLKLTILVNL; TILVNLLISCGL; EFSAMYDLMFEV; F SAMYDLMFEVS; SAMYDLMFEVSK; AMYDLMFEVSKP; MYDLMFEVSKPL; YDLMFEVSK PLQ; LMFEVSKPLQEL (SEQ ID NOs: 2951-2997) | A0201 TABLE B-2 |
| 9mer: LAACSLTGK; KARLESSVK; KAVEKIGMK; KIGMKDMTK; IIAIVKVMK; AIVKV MKAK; KQTGSKVSK; QTGSKVSKK; IQAIQVAGK; IQVAGKFVK; GTVTQAAEK; AIAKA MEDK; LVACSLTGK; KLNELEENK; KVDKDQLLK; KLGLQEMIK; KTVTQAAEK; MIANT IEDK; QTGSKVSEK; GTVTQVAEK; LAACSLTGK; KARLESSVK; IIAIVKVMK; AIVKV MKAK; QTGSKVSEK; AIAQAMEEK; KIRLERSAK; AIKKDAALK; KLGIQEMTK; HTKNY CTLK; KNYCTLKKK; KARLESSVK; IALTLQFLK; KELYELMLK; GLTGATKIK; KIKLE SSAK; LIRVKGKQK (SEQ ID NOs: 2998-3034)<br>10mer: LLAACSLTGK; ITNEIEKAIK; KIRVADLTIK; ATEEETITFK; ILNAAKAVEK; MTKTVEEAAK; TANGIIEIVK; GIIEIVKVMK; IEIVKVMKAK; VMKAKVENIK; GIIA IVKVMK; IAIVKVMKAK; MTKHTKNLIK; KLESSAQEIK; GVNFEAFTDK; AFTDKQTGS | A0301 TABLE B-3 |

TABLE B-continued

Predicted MHC class 1 binding peptides P derived from Borrelia antigen DbpA (8-, 9-, 10-, 11-, and 12-mers), predicted as detailed in Example 18. The binding peptides P are sorted per HLA-allele.

K; KQTGSKVSKK; VSKKPEFILK; KIQAIQVAGK; AIQVAGKFVK; KPLEEIGIQK; LAI
AKAMEDK; MTKYIKNLLK; LLVACSLTGK; KIRVINLSVK; VINLSVKELK; ILKDNVGM
NK; NKVDKDQLLK; MLNAAGSLQK; IKTVTQAAEK; LMIANTIEDK; KIKGKQETNK; RL
ESSAQEIK; KANAKKEGVK; GVKFEAFTDK; AFTDKQTGSK; KQTGSKVSEK; VSEKPEF
ILK; KIQAIQVAEK; AIQVAEKFVK; KPLEEIGIQK; LAIAQAMEDK; KQHEALKNLK; L
LAACSLTGK; ITNEIDKAIK; VADLTIEFLK; ATEEETITFK; AVEKIGMKVK; TANGII
AIVK; GIIAIVKVMK; IAIVKVMKAK; VMKAKVENIK; RLESSAQEIK; KANAKKEGVK;
GVKFEAFTDK; AFTDKQTGSK; KQTGSKVSEK; VSEKPEFILK; KIKAIQVAEK; AIQVA
EKFVK; KPLEEIGIQK; IQKMTGTVTK; LAIAQAMEEK; ISCGLTGATK; TKIRLERSAK;
GVNFDAFKDK; KVRATTVAEK; QKLGIQEMTK; LEIAKKMREK; KLQRVHTKNY; VHTK
NYCTLK; HTKNYCTLKK; ITNEIDKAIK; VDTNAFTDQK; KTGAKMGGPK; IIALTLQFL
K; ISCGLTGATK; TKIKLESSAK; IVDEIDAIKK; AFTDSATGGK; KVARSGSESR; SES
RAGNFIK; RAGNFIKQAK; KVRAIDTAEK; MTKEVSDAAK; LEIAKKMREK; KMREKLIR
VK; KLIRVKGKQK; KQKLNPETNK (SEQ ID NOs: 3035-3123)
11mer: SLLAACSLTGK; LLAACSLTGKA; KVAGPKIRAAK; GIYDLILNAAK; KVMKAK
VENIK; KVGGSQIRAAK; KVSKKPEFILK; AMYDLMLDVSK; MTKYIKNLLKL; GLLVAC
SLTGK; AKIRVINLSVK; RVINLSVKELK; NILKDNVGMNK; LMLNAAGSLQK; MLNAAG
SLQKL; ILMIANTIEDK; MIANTIEDKLK; MTKYIKNLLLK; KVSEKPEFILK; AMYDLM
LDVSK; ILAIAQAMEDK; SLLAACSLTGK; LLAACSLTGKA; KVAGSQIRDAK; LIYRTA
EAVEK; KVMKAKVENIK; MTKYIKKNLLK; KVSEKPEFILK; AKIKAIQVAEK; AMYDLM
LDVSK; GIQKMTGTVTK; ILAIAQAMEEK; ALKGVNEDAFK; AKVRATTVAEK; KVRATT
VAEKF; AMYDLMFEVSK; LMFEVSKPLQK; RVHTKNYCTLK; HTKNYCTLKKK; KMGGPK
TREAK; RIIALTLQFLK; IIALTLQFLKE; AKVRAIDTAEK; AMYDLMFEVSK; KKMREK
LIRVK; KMREKLIRVKG (SEQ ID NOs: 3124-3169)
12mer: ASLLAACSLTGK; SLLAACSLTGKA; GKVAGPKIRAAK; KVAGPKIRAAKI; SG
IYDLILNAAK; GIYDLILNAAKA; VKVMKAKVENIK; KTTADGIIAIVK; SKVSKKPEFI
LK; KVSKKPEFILKA; SAMYDLMLDVSK; AMYDLMLDVSKP; KMTGTVTQAAEK; AMEDK
LNNVNTK; MTKYIKNLLKLT; VGLLVACSLTGK; DAKIRVINLSVK; IRVINLSVKELK;
RVINLSVKELKE; ANILKDNVGMNK; GMNKVDKDQLLK; DLMLNAAGSLQK; LMLNAAGS
LQKL; MLNAAGSLQKLG; LMIANTIEDKLK; MIANTIEDKLKK; LLVACGLTGETK; KIR
LESSAQEIK; SKVSEKPEFILK; SAMYDLMLDVSK; AMYDLMLDVSKP; KMTGTVTQVAE
K; ASLLAACSLTGK; SLLAACSLTGKA; GKVAGSQIRDAK; KVAGSQIRDAKK; KLVADL
TIEFLK; DLIYRTAEAVEK; LIYRTAEAVEKI; RTAEAVEKIGMK; KTTANGIIAIVK; V
KVMKAKVENIK; LLVACGLTGETK; KIRLESSAQEIK; SKVSEKPEFILK; SAMYDLMLD
VSK; AMYDLMLDVSKP; IGIQKMTGTVTK; KMTGTVTKEAEK; LLISCGLTGATK; AALK
GVNFDAFK; ALKGVNEDAFKD; EAKVRATTVAEK; SAMYDLMFEVSK; AMYDLMFEVSKP;
DLMFEVSKPLQK; LMFEVSKPLQKL; KMREKLQRVHTK; QRVHTKNYCTLK; RVHTKNY
CTLKK; AKMGGPKTREAK; KMGGPKTREAKL; LRIIALTLQFLK; RIIALTLQFLKE; LL
ISCGLTGATK; QAKVRAIDTAEK; SAMYDLMFEVSK; AMYDLMFEVSKP; AKKMREKLIR
VK; KKMREKLIRVKG; KMREKLIRVKGK (SEQ ID NOs: 3170-3240)

9mer: LAACSLTGK; KAVEKIGMK; KIGMKDMTK; IIEIVKVMK; KQAVEEAAK; IIAIV A1101
KVMK; AIVKVMKAK; FTDKQTGSK; KQTGSKVSK; QTGSKVSKK; IQAIQVAGK; IQVAG TABLE
KFVK; KAIKEEAEK; SSGAFSAMY; GTVTQAAEK; AIAKAMEDK; LVACSLTGK; KLNEL B-4
EENK; INLSVKFLK; KVDKDQLLK; KLGLQEMIK; KTVTQAAEK; MIANTIEDK; NTIED
KLKK; KYIKKNLLK; FTDKQTGSK; QTGSKVSEK; IQAIQVAEK; IQVAEKFVK; KAIKE
EAEK; SSGAFSAMY; GTVTQVAEK; AIAQAMEDK; LAACSLTGK; GSQIRDAKK; ADLTI
EFLK; SGIYDLIYR; IIAIVKVMK; AIVKVMKAK; KYIKKNLLK; FTDKQTGSK; QTGSK
VSEK; IQVAEKFVK; KAIKEEAEK; SSGAFSAMY; GTVTKEAEK; AIAQAMEEK; ITDEI
DAIK; AIKKDAALK; KGVNFDAFK; IAIEEEATK; SSGEFSAMY; KLGIQEMTK; AQGVL
EIAK; HTKNYCTLK; STFTDEKCK; DTNAFTDQK; IALTLQFLK; TLQFLKETK; KELYE
LMLK; KIKLESSAK; IVDEIDAIK; FTDSATGGK; TAIEEEATK; SSGEFSAMY; AQGVL
EIAK (SEQ ID NOs: 3241-3306)
10mer: LLAACSLTGK; ITNEIEKAIK; QTGGKVAGPK; VAGPKIRAAK; KIRVADLTIK;
ATEEETITEK; ILNAAKAVEK; MTKTVEEAAK; TANGIIEIVK; GIIEIVKVMK; VMKA
KVENIK; TADGIIAIVK; GIIAIVKVMK; IAIVKVMKAK; MTKHTKNLIK; VACDLTGET
K; GVNFEAFTDK; AFTDKQTGSK; KQTGSKVSKK; VSKKPEFILK; KIQAIQVAGK; AIQ
VAGKFVK; GSSGAFSAMY; TGTVTQAAEK; TAEGILAIAK; LAIAKAMEDK; MTKYIKNL
LK; LLVACSLTGK; KIRVINLSVK; VINLSVKFLK; ILKDNVGMNK; MLNAAGSLQK; IK
TVTQAAEK; LMIANTIEDK; IANTIEDKLK; ANTIEDKLKK; VACGLTGETK; RLESSAQ
EIK; GVKFEAFTDK; AFTDKQTGSK; KQTGSKVSEK; VSEKPEFILK; KIQAIQVAEK; A
IQVAEKFVK; GSSGAFSAMY; TGTVTQVAEK; LAIAQAMEDK; IAQAMEDKLK; KQHEAL
KNLK; LLAACSLTGK; ITNEIDKAIK; VADLTIEFLK; ATEEETITEK; FSGIYDLIYR;
AVEKIGMKVK; TANGIIAIVK; GIIAIVKVMK; IAIVKVMKAK; VMKAKVENIK; VACGL
TGETK; RLESSAQEIK; GVKFEAFTDK; AFTDKQTGSK; KQTGSKVSEK; VSEKPEFILK;
KIKAIQVAEK; AIQVAEKFVK; GSSGAFSAMY; IQKMTGTVTK; TGTVTKEAEK; LAIA
QAMEEK; ISCGLTGATK; ITDEIDAIKK; GVNEDAFKDK; SENPFILEAK; KVRATTVAE
K; GSSGEFSAMY; TAQGVLEIAK; VHTKNYCTLK; HTKNYCTLKK; ITNEIDKAIK; VDT
NAFTDQK; AFTDQKTGAK; KTGAKMGGPK; IIALTLQFLK; IALTLQFLKE; LTLQELKE
TK; ISCGLTGATK; TKIKLESSAK; AIVDEIDAIK; IVDEIDAIKK; AFTDSATGGK; SE
SRAGNFIK; RAGNFIKQAK; KVRAIDTAEK; LTAIEEEATK; GSSGEFSAMY; MTKEVSD
AAK; TAQGVLEIAK; KLIRVKGKQK; KQKLNPETNK (SEQ ID NOs: 3307-3407)
11mer: SLLAACSLTGK; SVKDITNEIEK; KVAGPKIRAAK; EATEEETITEK; GIYDLI
LNAAK; TTANGIIEIVK; KVMKAKVENIK; AVEKIGMQGMK; TTADGIIAIVK; DGIIAI
VKVMK; EGVNFEAFTDK; KVSKKPEFILK; AKIQAIQVAGK; QAIQVAGKFVK; AMYDLM
LDVSK; MTGTVTQAAEK; TTAEGILAIAK; MTKYIKNLLKL; SVKDITDEIDK; RVINLS TABLE B-continued Predicted MHC class 1 binding peptides P derived from Borrelia antigen DbpA (8-, 9-, 10-, 11-, and 12-mers), predicted as detailed in Example 18. The binding peptides P are sorted per HLA-allele.

VKFLK; VINLSVKELKE; NILKDNVGMNK; LMLNAAGSLQK; ILMIANTIEDK; MIANTI
EDKLK; MTKYIKKNLLK; KVSEKPEFILK; AKIQAIQVAEK; AMYDLMLDVSK; MTGTVT
QVAEK; SLLAACSLTGK; SVKDITNEIDK; KVAGSQIRDAK; LVADLTIEFLK; KATEEE
TITFK; LIYRTAEAVEK; TTANGIIAIVK; NGIIAIVKVMK; KVMKAKVENIK; MTKYIK
KNLLK; KVSEKPEFILK; KAIQVAEKFVK; AMYDLMLDVSK; GIQKMTGTVTK; MTGTVT
KEAEK; ALKGVNFDAFK; KGVNFDAFKDK; GVNFDAFKDKK; VSENPFILEAK; AMYDLM
FEVSK; LMFEVSKPLQK; TTAQGVLEIAK; RVHTKNYCTLK; VHTKNYCTLKK; SVKDIT
NEIDK; GVDTNAFTDQK; RIIALTLQFLK; AIVDEIDAIKK; AMYDLMFEVSK; TTAQGV
LEIAK (SEQ ID NOs: 3408-3467)
12mer: ASLLAACSLTGK; SSVKDITNEIEK; GKVAGPKIRAAK; LEATEEETITFK; SG
IYDLILNAAK; GIYDLILNAAKA; KTVEEAAKENPK; KTTANGIIEIVK; TTANGIIEIV
KV; VKVMKAKVENIK; KTTADGIIAIVK; TTADGIIAIVKV; ADGIIAIVKVMK; SSAQE
IKDEINK; KEGVNFEAFTDK; SKVSKKPEFILK; KVSKKPEFILKA; KAKIQAIQVAGK;
IQAIQVAGKFVK; SAMYDLMLDVSK; AMYDLMLDVSKP; KMTGTVTQAAEK; PTTAEGIL
AIAK; SSVKDITDEIDK; IRVINLSVKELK; RVINLSVKELKE; GMNKVDKDQLLK; DLM
LNAAGSLQK; SLQKLGLQEMIK; GILMIANTIEDK; LMIANTIEDKLK; MIANTIEDKLK
K; MTKYIKKNLLKL; SSAQEIKDEINK; SKVSEKPEFILK; KVSEKPEFILKA; KAKIQA
IQVAEK; SAMYDLMLDVSK; AMYDLMLDVSKP; KMTGTVTQVAEK; LAIAQAMEDKLK; A
SLLAACSLTGK; SSVKDITNEIDK; GKVAGSQIRDAK; KVAGSQIRDAKK; KLVADLTIE
FLK; LVADLTIEFLKA; LKATEEETITEK; DLIYRTAEAVEK; RTAEAVEKIGMK; KTTA
NGIIAIVK; TTANGIIAIVKV; ANGIIAIVKVMK; VKVMKAKVENIK; MTKYIKKNLLKL;
SSAQEIKDEINK; SKVSEKPEFILK; KVSEKPEFILKA; IKAIQVAEKFVK; SAMYDLM
LDVSK; AMYDLMLDVSKP; IGIQKMTGTVTK; GIQKMTGTVTKE; KMTGTVTKEAEK; GI
LAIAQAMEEK; AALKGVNEDAFK; KGVNEDAFKDKK; GVSENPFILEAK; SAMYDLMFEV
SK; AMYDLMFEVSKP; DLMFEVSKPLQK; PTTAQGVLEIAK; TTAQGVLEIAKK; QRVHT
KNYCTLK; RVHTKNYCTLKK; SSVKDITNEIDK; GGVDTNAFTDQK; LRIIALTLQFLK;
RIIALTLQFLKE; IALTLQFLKETK; KAIVDEIDAIKK; SAMYDLMFEVSK; AMYDLMFE
VSKP; PTTAQGVLEIAK; TTAQGVLEIAKK (SEQ ID NOs: 3468-3552)

| | |
|---|---|
| 9mer: KYNKIILTL; EFSGIYDLI; DESGIYDLI; KYIKNLLKL; KYNKIILTL; EFSGI YDLI; RIIALTLQF (SEQ ID NOs: 3553-3559)<br>10mer: IKYNKIILTL; KYNKIILTLT; TKYIKNLLKL; KYIKNLLKLT; KYIKKNLLKL; IKYNKIILTL; KYNKIILTLT; KYIKKNLLKL; EFSAMYDLME; EFSAMYDLMF (SEQ ID NOs: 3560-3569)<br>11mer: KYNKIILTLTL; KYIKNLLKLTL (SEQ ID NOs: 3570-3571)<br>12mer: IKYNKIILTLTL; KYNKIILTLTLL; TKYIKNLLKLTL; KYIKNLLKLTLI; IK YNKIILTLTL; KYNKIILTLTLL (SEQ ID NOs: 3572-3577) | A2402 TABLE B-5 |
| 9mer: EIVKVMKAK; EIKDEINKI; TTAEGILAI; EIKDEINKI; TTAEGILAI; EIKDE INKI; TTAEGILAI; ELYELMLKI (SEQ ID NOs: 3578-3585) | A2501 TABLE B-6 |
| 9mer: QAIQVAGKF; TTAEGILAI; TTVEGILMI; TTAEGILAI; TTAEGILAI (SEQ ID NOs: 3586-3590)<br>10mer: EIVKVMKAKV; DGIIAIVKVM; EAVEKIGMKV (SEQ ID NOs: 3591-3593)<br>12mer: ETGSSGEFSAMY (SEQ ID NO: 3594) | A2601 TABLE B-7 |
| 9mer: SSGAFSAMY; AFSAMYDLM; AMYDLMLDV; SSGAFSAMY; AFSAMYDLM; AMYDL MLDV; LVADLTIEF; FSGIYDLIY; SSGAFSAMY; AFSAMYDLM; AMYDLMLDV; SSGEF SAMY; FSAMYDLME; AMYDLMFEV; RIIALTLQF; SSGEFSAMY; FSAMYDLME; AMYDL MFEV (SEQ ID NOs: 3595-3612)<br>10mer: GSSGAFSAMY; GSSGAFSAMY; EFSGIYDLIY; GSSGAFSAMY; GSSGEFSAMY; EFSAMYDLMF; GSSGEFSAMY; EFSAMYDLME (SEQ ID NOs: 3613-3620) | A2902 TABLE B-8 |
| 9mer: IIAIVKVMK; KQTGSKVSK; IQVAGKFVK; AGKFVKAIK; MTKYIKNLL; INLSV KFLK; KTVQAAEK; KYIKKNLLK; SGIYDLIYR; IIAIVKVMK; KYIKKNLLK; GATKI RLER; KIRLERSAK; KGVNEDAFK; AMYDLMFEV; HTKNYCTLK; KNYCTLKKK; IALTL QFLK; KIKLESSAK; SATGGKVAR; VARSGSESR; AGNFIKQAK; AMYDLMFEV; KMREK LIRV (SEQ ID NOs: 3621-3644)<br>10mer: MTKTVEEAAK; VMKAKVENIK; GSQIRAAKIR; MTKHTKNLIK; VSKKPEFILK; KIQAIQVAGK; MTKYIKNLLK; KIRVINLSVK; VINLSVKELK; KIKGKQETNK; KANA KKEGVK; KIQAIQVAEK; KQHEALKNLK; FSGIYDLIYR; VMKAKVENIK; KANAKKEGV K; KIKAIQVAEK; KVRATTVAEK; GVLEIAKKMR; VHTKNYCTLK; HTKNYCTLKKK; KTG AKMGGPK; IIALTLQFLK; KVARSGSESR; RAGNFIKQAK; KVRAIDTAEK; MTKEVSDA AK; GVLEIAKKMR; KMREKLIRVK (SEQ ID NOs: 3645-3673)<br>11mer: RVINLSVKFLK; AMYDLMFEVSK; RVHTKNYCTLK; RIIALTLQFLK; AMYDLM FEVSK (SEQ ID NOs: 3674-3678)<br>12mer: SKVSKKPEFILK; KTGAKKGGPQIR; IRVINLSVKELK; SAMYDLMFEVSK; KM REKLQRVHTK; QRVHTKNYCTLK; RVHTKNYCTLKK; KTGAKMGGPKTR; LRIIALTLQF LK; RAGNFIKQAKVR; SAMYDLMFEVSK; KMREKLIRVKGK (SEQ ID NOs: 3679-3690) | A3101 TABLE B-9 |
| 9mer: KYNKIILTL; LTLTLLASL; ITNEIEKAI; KIRVADLTI; RVADLTIKF; ATEEE TITF; TTADGIIAI; KIQAIQVAG; LMLDVSKPL; TTAEGILAI; KIRVINLSV; RVINL SVKF; GILMIANTI; LMLDVSKPL; KMTGTVTQV; TTAEGILAI; KYNKIILTL; LTLTL | A3201 TABLE B-10 |

TABLE B-continued

Predicted MHC class 1 binding peptides P derived from Borrelia antigen DbpA (8-, 9-, 10-, 11-, and 12-mers), predicted as detailed in Example 18. The binding peptides P are sorted per HLA-allele.

LASL; ITNEIDKAI; KKLVADLTI; LVADLTIEF; ATEEETITF; RTAEAVEKI; TTANG
IIAI; KAIQVAEKF; LMLDVSKPL; TTAEGILAI; KTENNLLKL; AMYDLMFEV; LMFEV
SKPL; TTAQGVLEI; ITNEIDKAI; KLRIIALTL; RIIALTLQF; LMLKISKAV; KISKA
VEGI; GIQNMTATV; MTATVSMGI; KTENNLLKL; AMYDLMFEV; LMFEVSKPL; TTAQG
VLEI (SEQ ID NOs: 3691-3732)
10mer: IRVINLSVKF; RVINLSVKFL; KLVADLTIEF; KTTANGIIAI; LRIIALTLQF;
RIIALTLQFL; ASMGVNEDAF (SEQ ID NOs: 3733-3739)
11mer: KTENNLLKLTI (SEQ ID NO: 3740)
12mer: NKTFNNLLKLTI; KTENNLLKLTIL (SEQ ID NOs: 3741-3742)

9mer: LAACSLTGK; FTETQTGGK; LNAAKAVEK; IIEIVKVMK; EIVKVMKAK; IIAIV     A6801
KVMK; QTGSKVSKK; GTVTQAAEK; NTKQHEALK; EALKNLEGK; LVACSLTGK; INLSV    TABLE
KFLK; KTVTQAAEK; MIANTIEDK; NTIEDKLKK; QTGSKVSEK; GTVTQVAEK; EALKN    B-11
LKEK; LAACSLTGK; FTETQTGGK; SGIYDLIYR; EAVEKIGMK; IIAIVKVMK; QTGSK
VSEK; GTVTKEAEK; AIAQAMEEK; DALKNLEEK; GATKIRLER; ITDEIDAIK; ENPFI
LEAK; IAIEEEATK; YDLMFEVSK; EIAKKMREK; HTKNYCTLK; ENSTFTDEK; STFTD
EKCK; DTNAFTDQK; IALTLQFLK; TLQFLKETK; YGAGEDEFK; MTATVSMGI; IVDEI
DAIK; FTDSATGGK; SATGGKVAR; VARSGSESR; ESRAGNFIK; TAIEEEATK; YDLME
EVSK; EIAKKMREK (SEQ ID NOs: 3743-3791)
10mer: LLAACSLTGK; ITNEIEKAIK; MTKTVEEAAK; TANGIIEIVK; GIIEIVKVMK;
QAVEEAAKEK; TADGIIAIVK; GIIAIVKVMK; IAIVKVMKAK; MTKHTKNLIK; EIKD
EINKIK; EINKIKANAK; GVNFEAFTDK; TGTVTQAAEK; TAEGILAIAK; LAIAKAMED
K; MTKYIKNLLK; LLVACSLTGK; ITDEIDAIKK; VINLSVKELK; EIEEEANILK; MLN
AAGSLQK; IKTVTQAAEK; LMIANTIEDK; IANTIEDKLK; EIKDEINKIK; EINKIKAN
AK; TGTVTQVAEK; LAIAQAMEDK; IAQAMEDKLK; LLAACSLTGK; ITNEIDKAIK; EI
DKAIKAAK; VADLTIEFLK; FSGIYDLIYR; TANGIIAIVK; GIIAIVKVMK; IAIVKVM
KAK; EIKDEINKIK; EINKIKANAK; TGTVTKEAEK; LAIAQAMEEK; NNKTENNLLK; I
SCGLTGATK; TGATKIRLER; DITDEIDAIK; ITDEIDAIKK; DAIKKDAALK; LKGVNE
DAFK; NPFILEAKVR; KVRATTVAEK; TAQGVLEIAK; VHTKNYCTLK; HTKNYCTLK;
KENSTFTDEK; NSTFTDEKCK; ITNEIDKAIK; VDTNAFTDQK; IIALTLQFLK; LTLQF
LKETK; ETKEEAIKLK; EYGAGEDEFK; NNKTENNLLK; ISCGLTGATK; AIVDEIDAIK;
DSATGGKVAR; KVARSGSESR; LTAIEEEATK; MTKEVSDAAK; TAQGVLEIAK (SEQ
ID NOs: 3792-3861)
11mer: EATEEETITFK; TTANGIIEIVK; TTADGIIAIVK; FVKAIKEEAAK; MTGTVT
QAAEK; TTAEGILAIAK; MIKTVTQAAEK; MIANTIEDKLK; MTKYIKNLLK; FVKAIK
EEEAK; MTGTVTQVAEK; LVADLTIEFLK; EFSGIYDLIYR; TTANGIIAIVK; MTKYIK
KNLLK; FVKAIKEEAEK; MTGTVTKEAEK; FVIAIEEEATK (SEQ ID NOs: 3862-
3879)
12mer: LEATEEETITFK; KTTANGIIEIVK; KTTADGIIAIVK; SAMYDLMLDVSK; KM
TGTVTQAAEK; EMIKTVTQAAEK; LMIANTIEDKLK; MIANTIEDKLKK; SAMYDLMLDV
SK; KMTGTVTQVAEK; KLVADLTIEFLK; DEFSGIYDLIYR; KTTANGIIAIVK; SAMYD
LMLDVSK; KMTGTVTKEAEK; AALKGVNEDAFK; EAKVRATTVAEK; KEVIAIEEEATK;
SAMYDLMFEVSK; FTDSATGGKVAR; SAMYDLMFEVSK (SEQ ID NOs: 3880-
3900)

9mer: GPKIRAAKI; ILKAKIQAI; FSAMYDLML; KIRVINLSV; PPTTAQGVL; GPKTR   B0702
EAKL; KLRIIALTL; PPTTAQGVL (SEQ ID NOs: 3901-3908)                   TABLE
10mer: RAAKIRVADL; KPKTTADGII; KPEFILKAKI; KPEFILKAKI; TPATTAEGIL;   B-12
KPEFILKAKI; NPPTTAQGVL; NPPTTAQGVL (SEQ ID NOs: 3909-3916)
11mer: KPLQKLGIQEM (SEQ ID NO: 3917)

9mer: MIKYNKIIL; GPKIRAAKI; AAKIRVADL; FSGIYDLIL; DAKIRVINL; MIKTV    B0801
TQAA; MTKYIKKNL; YIKKNLLKL; ILKAKIQAI; FSAMYDLML; VNKKQHEAL; NLKEK   TABLE
ANTA; MIKYNKIIL; MTKYIKKNL; YIKKNLLKL; ILKAKIKAI; FSAMYDLML; MIKCN   B-13
NKTF; NNLLKLTIL; DAIKKDAAL; EAKVRATTV; LMFEVSKPL; KMREKLQRV; TLKKK
ENST; GPKTREAKL; EAKLRIIAL; KLRIIALTL; ELMLKISKA; LMLKISKAV; MIKCN
NKTF; NNLLKLTIL; LMFEVSKPL (SEQ ID NOs: 3918-3949)
10mer: RAAKIRVADL; FILKAKIQAI; YIKNLLKLTL; LLKDMYDLML; MTKYIKKNLL;
KYIKKNLLKL; LLKLSLIVSL; FILKAKIQAI; NVNKKQHEAL; KNLKEKANTA; NLKE
KANTAA; MTKYIKKNLL; KYIKKNLLKL; LLKLSLIVSL; FILKAKIKAI; ENNLLKLTI
L; IDAIKKDAAL; LEAKVRATTV; RVHTKNYCTL; TLKKKENSTF; REAKLRIIAL; EAK
LRIIALT; FLKETKEEAI; YELMLKISKA; ELMLKISKAV; ENNLLKLTIL; FIKQAKVR
AI; LIRVKGKQKL (SEQ ID NOs: 3950-3977)
11mer: EFILKAKIQAI; QLLKDMYDLML; YIKKNLLKLSL; EFILKAKIQAI; YIKKNL
LKLSL; EFILKAKIKAI; MGGPKTREAKL; TREAKLRIIAL; NFIKQAKVRAI (SEQ
ID NOs: 3978-3986)
12mer: PEFILKAKIQAI; DQLLKDMYDLML; KYIKKNLLKLSL; NAKKEGVKFEAF; PE
FILKAKIQAI; KYIKKNLLKLSL; NAKKEGVKFEAF; PEFILKAKIKAI; EFILKAKIKA
IQ; KMGGPKTREAKL; KTREAKLRIIAL; REAKLRIIALTL; LYELMLKISKAV; GNFIK
QAKVRAI (SEQ ID NOs: 3987-4000)

9mer: IKYNKIILT; NKIILTLTL; LTLTLLASL; ASLLAACSL; RVADLTIKF; ATEEE    B1503
TITF; VMKAKVENI; IKLSLIVSL; KLESSAQEI; NAKKEGVNF; KEGVNFEAF; SKVSK   TABLE
KPEF; KKPEFILKA; ILKAKIQAI; AKIQAIQVA; KLKKSGSSG; LKKSGSSGA; KKSGS   B-14
SGAF; SSGAFSAMY; FSAMYDLML; AMYDLMLDV; LMLDVSKPL; IQKMTGTVT; KMTGT
VTQA; KQHEALKNL; IKNLLKLTL; LKLTLIVGL; RVINLSVKF; LKDMYDLML; LMLNA
AGSL; LQKLGLQEM; KKNLLKLSL; LKLSLIVSL; RLESSAQEI; NAKKEGVKF; KEGVK TABLE B-continued Predicted MHC class 1 binding peptides P derived from Borrelia antigen DbpA (8-, 9-, 10-, 11-, and 12-mers), predicted as detailed in Example 18. The binding peptides P are sorted per HLA-allele.

FEAF; SKVSEKPEF; ILKAKIQAI; AKIQAIQVA; QAIQVAEKF; KLKKSGSSG; LKKSG
SSGA; KKSGSSGAF; SSGAFSAMY; FSAMYDLML; AMYDLMLDV; LMLDVSKPL; IQKMT
GTVT; KMTGTVTQV; TQVAEKTPA; KKQHEALKN; KQHEALKNL; IKYNKIILT; NKIIL
TLTL; LTLTLLASL; ASLLAACSL; SQIRDAKKL; KKLVADLTI; LVADLTIEF; LKATE
EETI; ATEEETITF; FSGIYDLIY; LIYRTAEAV; VMKAKVENI; KKNLLKLSL; LKLSL
IVSL; RLESSAQEI; NAKKEGVKF; KEGVKFEAF; SKVSEKPEF; AKIKAIQVA; KAIQV
AEKF; KLKKSGSSG; LKKSGSSGA; KKSGSSGAF; SSGAFSAMY; FSAMYDLML; AMYDL
MLDV; LMLDVSKPL; IQKMTGTVT; KQQDALKNL; MIKCNNKTF; KTENNLLKL; LKLTI
LVNL; LKGVNFDAF; GSGVSENPF; AKVRATTVA; RATTVAEKF; KETGSSGEF; SSGEF
SAMY; FSAMYDLMF; AMYDLMFEV; LMFEVSKPL; LQKLGIQEM; KMREKLQRV; LQRVH
TKNY; VHTKNYCTL; LKKKENSTF; KKKENSTFT; KLRIIALTL; RIIALTLQF; FKELY
ELML; LMLKISKAV; IQNMTATVS; QNMTATVSM; MIKCNNKTF; KTENNLLKL; LKLTI
LVNL; IKLESSAKA; KLESSAKAI; AIKKEAASM; EAASMGVNF; SMGVNEDAF; IKQAK
VRAI; RAIDTAEKF; KETGSSGEF; SSGEFSAMY; FSAMYDLME; AMYDLMFEV; LMFEV
SKPL; LQELGIQDM; AKENPPTTA; KMREKLIRV; KQKLNPETN (SEQ ID NOs:
4001-4124)
10mer: KKEGVNFEAF; IQAIQVAGKF; LKKSGSSGAF; IQAIQVAEKF; LKKSGSSGAF;
LKKSGSSGAF; KLQRVHTKNY; LQRVHTKNYC; TLKKKENSTF; LKKKENSTFT; IQNM
TATVSM (SEQ ID NOs: 4125-4135)
11mer: KLKKSGSSGAF; LKKSGSSGAFS; KLKKSGSSGAF; LKKSGSSGAFS; KLKKSG
SSGAF; LKKSGSSGAFS; KLKETGSSGEF; CTLKKKENSTF; KLKETGSSGEF (SEQ
ID NOs: 4136-4144)
12mer: EKLKKSGSSGAF; KLKKSGSSGAFS; EKLKKSGSSGAF; KLKKSGSSGAFS; EK
LKKSGSSGAF; KLKKSGSSGAFS; KKTGSGVSENPF; REKLQRVHTKNY; YCTLKKKENS
TF (SEQ ID NOs: 4145-4153)

| | |
|---|---|
| 9mer: GEDEFSGIY; DEFSGIYDL; GEEDESGIY; GEDEFSGIY; DEFSGIYDL; SENPE ILEA; LEAKVRATT; EEAIKLKEY; GEDEFKELY; DEFKELYEL; YELMLKISK (SEQ ID NOs: 4154-4164)<br>10mer: EDEFSGIYDL; DEFSGIYDLI; EDEFSGIYDL; DEFSGIYDLI; EDEFKELYEL; DEFKELYELM SEQ ID NOs: 4165-4170)<br>11mer: LEATEEETITF; DEFSGIYDLIL; DEFSGIYDLIY; GEDEFKELYEL; EDEFKE LYELM; DEFKELYELML (SEQ ID NOs: 4171-4176)<br>12mer: EDEFSGIYDLIL; DEFSGIYDLILN; EDEFSGIYDLIY; DEFSGIYDLIYR; DE IDAIKKDAAL; AGEDEFKELYEL; GEDEFKELYELM; EDEFKELYELML; DEFKELYELM LK (SEQ ID NOs: 4177-4185) | B1801 TABLE B-15 |
| 9mer: DAGVKTDAF; RVADLTIKF; QAIQVAGKF; FSAMYDLML; QAAEKTPPT; QAAEK TPPT; QAIQVAEKF; FSAMYDLML; DAGVNTDAF; LVADLTIEF; FSGIYDLIY; FSAMY DLML; MIKCNNKTF; FVIAIEEEA; FSAMYDLMF; LMFEVSKPL; MIKCNNKTF; EAASM GVNF; FSAMYDLMF; LMFEVSKPL (SEQ ID NOs: 4186-4205)<br>10mer: EATEEETITF (SEQ ID NO: 4206) | B3501 TABLE B-16 |
| 9mer: DEFSGIYDL; IEIVKVMKA; EDESGIYDL; KEGVNFEAF; PEFILKAKI; HEALK NLEG; KEIEEEANI; QEMIKTVTQ; AEKTPPTTV; GETKIRLES; KEGVKFEAF; PEFIL KAKI; AEKTPATTA; AEGILAIAQ; KEKANTAAT; IEFLKATEE; DEFSGIYDL; GETKI RLES; KEGVKFEAF; PEFILKAKI; KEAEKTPPT; AEGILAIAQ; SENPFILEA; KETGS SGEF; GEFSAMYDL; AMYDLMFEV; REKLQRVHT; REAKLRIIA; DEFKELYEL; YELML KISK; SESRAGNFI; KETGSSGEF; GEFSAMYDL; AMYDLMFEV; QELGIQDMT; REKLI RVKG (SEQ ID NOs: 4207-4242)<br>10mer: KENGAGEDEF; EDEFSGIYDL; DEFSGIYDLI; EEDESGIYDL; KPEFILKAKI; AEGILAIAKA; KEAIADGVKL; KEIEEEANIL; QEMIKTVTQA; VEGILMIANT; KPEF ILKAKI; AEGILAIAQA; KENGAGEDEF; EDEFSGIYDL; DEFSGIYDLI; KPEFILKAK I; KEAEKTPPTT; AEGILAIAQA; LEAKVRATTV; AEKFVIAIEE; SGEFSAMYDL; GEF SAMYDLM; FEVSKPLQKL; QEMKTVSDA; TREAKLRIIA; REAKLRIIAL; KETKEEAI KL; KEYGAGEDEF; EDEFKELYEL; DEFKELYELM; KELYELMLKI; YELMLKISKA; KE AASMGVNF; SGEFSAMYDL; GEFSAMYDLM; FEVSKPLQEL (SEQ ID NOs: 4243-4278)<br>11mer: GEDEFSGIYDL; GEEDESGIYDL; VEGILMIANTI; AEGILAIAQAM; GEDEFS GIYDL; AEGILAIAQAM; KETGSSGEFSA; SSGEFSAMYDL; SGEFSAMYDLM; GEFSAM YDLMF; TREAKLRIIAL; REAKLRIIALT; GEDEFKELYEL; EDEFKELYELM; FKELYE LMLKI; KELYELMLKIS; YELMLKISKAV; KETGSSGEFSA; SSGEFSAMYDL; SGEFSA MYDLM; GEFSAMYDLMF (SEQ ID NOs: 4279-4299)<br>12mer: AGEDEFSGIYDL; GEDEFSGIYDLI; AGEEDESGIYDL; GEEDESGIYDLI; IE FLKATEEETI; AGEDEFSGIYDL; GEDEFSGIYDLI; GSSGEFSAMYDL; SSGEFSAMYD LM; SGEFSAMYDLME; GEFSAMYDLMFE; KTREAKLRIIAL; TREAKLRIIALT; REAKL RIIALTL; AGEDEFKELYEL; GEDEFKELYELM; EFKELYELMLKI; FKELYELMLKIS; KELYELMLKISK; LYELMLKISKAV; YELMLKISKAVE; KEAASMGVNFDA; GSSGEFSA MYDL; SSGEFSAMYDLM; SGEFSAMYDLMF; GEFSAMYDLMFE (SEQ ID NOs: 4300-4325) | B4002 TABLE B-17 |
| 9mer: KEGVNFEAF; AEGILAIAK; QEMIKTVTQ; KEGVKFEAF; AEGILAIAQ; AEAVE KIGM; KEGVKFEAF; AEGILAIAQ; SENPFILEA; KETGSSGEF; GEFSAMYDL; EEAIK LKEY; SESRAGNFI; KETGSSGEF; GEFSAMYDL (SEQ ID NOs: 4326-4340)<br>10mer: KENGAGEDEF; KENGAGEEDF; AVEKIGMQGM; QEIKDEINKI; KPEFILKAKI; AEGILAIAKA; QEMIKTVTQA; QEIKDEINKI; KPEFILKAKI; AEGILAIAQA; KENG | B4402 TABLE B-18 |

TABLE B-continued

Predicted MHC class 1 binding peptides P derived from Borrelia antigen DbpA (8-, 9-, 10-, 11-, and 12-mers), predicted as detailed in Example 18. The binding peptides P are sorted per HLA-allele.

AGEDEF; QEIKDEINKI; KPEFILKAKI; AEGILAIAQA; SGEFSAMYDL; GEFSAMYDLM; QEMTKTVSDA; QEGGVDTNAF; REAKLRIIAL; KEEAIKLKEY; KEYGAGEDEF; KELYELMLKI; AVEGIGIQNM; KEAASMGVNF; SGEFSAMYDL; GEFSAMYDLM (SEQ ID NOs: 4341-4366)
11mer: AEGILAIAKAM; QEMIKTVTQAA; AEGILAIAQAM (SEQ ID NOs: 4367-4369)
12mer: TAEGILAIAQAM; AEGILAIAQAME (SEQ ID NOs: 4370-4371)

9mer: IEIVKVMKA; AEKTPPTTA; AEGILAIAK; AEKTPPTTV; AEKTPATTA; AEGILAIAQ; KEKANTAAT; NEIDKAIKA; KEAEKTPPT; AEKTPPTTA; AEGILAIAQ; LEEKANTAA; EEKANTAAT; SENPFILEA; AEKFVIAIE; AEENPPTTA; QEGGVDTNA; REAKLRIIA; SESRAGNFI; AEKELTAIE (SEQ ID NOs: 4372-4391)   B4501 TABLE B-19
10mer: AEDAGVKTDA; TETQTGGKVA; KEGVNFEAFT; AAEKTPPTTA; AEKTPPTTAE; AEGILAIAKA; QEMIKTVTQA; KEGVKFEAFT; SEKPEFILKA; VAEKTPATTA; AEKTPATTAE; AEGILAIAQA; NEIDKAIKAA; TETQTGGKVA; KEGVKFEAFT; SEKPEFILKA; EAEKTPPTTA; AEKTPPTTAE; AEGILAIAQA; NLEEKANTAA; EEKANTAATT; VSENPFILEA; SENPFILEAK; QEMTKTVSDA; AAEENPPTTA; AEENPPTTAQ; NEIDKAIKEA; AQEGGVDTNA; QEGGVDTNAF; TREAKLRIIA; REAKLRIIAL; YELMLKISKA (SEQ ID NOs: 4392-4423)
11mer: EAEDAGVKTDA; TAEGILAIAKA; AEGILAIAKAM; LQEMIKTVTQA; QEMIKTVTQAA; VSEKPEFILKA; SEKPEFILKAK; TAEGILAIAQA; AEGILAIAQAM; VSEKPEFILKA; SEKPEFILKAK; TAEGILAIAQA; AEGILAIAQAM; GVSENPFILEA; VSENPFILEAK; SENPFILEAKV; KETGSSGEFSA; IQEMTKTVSDA; QEMTKTVSDAA; KETGSSGEFSA; QEMTKTVQAA; QEMIKTVTQAA; QEMIKTVTQAA (SEQ ID NOs: 4424-4443; SEQ ID NO: 4450-4451)
12mer: KEAEDAGVKTDA; EEAAKENPKTTA; TTAEGILAIAKA; TAEGILAIAKAM; AEGILAIAKAME; KVSEKPEFILKA; AEKFVKAIKEEA; TTAEGILAIAQA; TAEGILAIAQAM; AEGILAIAQAME; KVSEKPEFILKA; AEKFVKAIKEEA; TTAEGILAIAQA; TAEGILAIAQAM; AEGILAIAQAME; SGVSENPFILEA; GVSENPFILEAK; VSENPFILEAKV; SENPFILEAKVR; AEKFVIAIEEEA; GIQEMTKTVSDA; IQEMTKTVSDAA; QEMTKTVSDAAE; KEAASMGVNEDA; AEKFLTAIEEEA (SEQ ID NOs: 4444-4448 and SEQ ID NOs: 4452-4471)

Preferred binding peptides P derived or predicted from *Borrelia* protein FlhF capable of interacting with one or more MHC class 1 molecules are listed in Table C:

TABLE C

Predicted MHC class 1 binding peptides P derived from Borrelia antigen FlhF (8-, 9-, 10-, 11-, and 12-mers), predicted as detailed in Example 19. The binding peptides P are sorted per HLA-allele.

FlhF antigenic polypeptide sequences

BORRELIA AFZELLI.ACA-1 (SEQ ID NO: 21)

BORRELIA AFZELLI.PKO (SEQ ID NO: 22)

BORRELIA GARINII.FAR04 (SEQ ID NO: 23)

BORRELIA GARINII.PBI (SEQ ID NO: 24)

BORRELIA GARINII.PBR (SEQ ID NO: 25)

BORRELIA BURGDORFERI.B31 (SEQ ID NO: 26)

BORRELIA BURGDORFERI.N40 (SEQ ID NO: 27)

BORRELIA BURGDORFERI.ZS7 (SEQ ID NO: 28)

| Predicted FlhF antigenic peptides P | HLA-allele |
|---|---|
| 9mer: FSLSDLDDY (SEQ ID NO: 4472)<br>10mer: WVEVSGYVRY; TTIAKLAAIY (SEQ ID NOs: 4473-4474)<br>11mer: DWVEVSGYVRY (SEQ ID NO: 4475)<br>12mer: KDWVEVSGYVRY; TTCVGNLISLIY (SEQ ID NOs: 4476-4477) | A0101 TABLE C-1 |
| 9mer: SIEDVLKEV; YIKDINEFI; FILVGPTGV; SLNIKIITI; QTYGDIMGI; KLAEMKELL; NLISLIYEM; SLIYEMKKV; QIVPHNISV; SVAEPLTFI; RISDDAEFI (SEQ ID NOs: 4478-4488) | A0201 TABLE C-2 |

TABLE C-continued

Predicted MHC class 1 binding peptides P derived from Borrelia antigen FlhF (8-, 9-, 10-, 11-, and 12-mers), predicted as detailed in Example 19. The binding peptides P are sorted per HLA-allele.

10mer: ILGLFSKDWV; GLFSKDWVEV; VFILVGPTGV; FILVGPTGVG; KSLNIKIITI; IQTYGDIMGI; FMKLAEMKEL; MKLAEMKELL; GNLISLIYEM; NLISLIYEMK; YEMKKVVSYV; YRISDDAEFI (SEQ ID NOs: 4489-4500)
11mer: LGLFSKDWVEV; GLFSKDWVEVS; SLSDLDDYERV; FMKLAEMKELL; KLAEMKELLNA; VGNLISLIYEM (SEQ ID NOs: 4501-4506)
12mer: ILGLFSKDWVEV; LGLESKDWVEVS; GLFSKDWVEVSG; FSLSDLDDYERV; MKLAEMKELLNA; CVGNLISLIYEM; NLISLIYEMKKV; LIYEMKKVVSYV (SEQ ID NOs: 4507-4514)

9mer: KNARVMTYK; VLKEVKSLK; SLKTELAHK; NINHPTITK; RVREDVVLY; VLYIAKTIK; LVGPTGVGK; PVRAIESFK; LILVDTIGK; HLAVSSTTK; HQFSPFNYK; LISLIYEMK; ISLIYEMKK (SEQ ID NOs: 4515-4527)    A0301 TABLE C-3
10mer: IEIIKKKYGK; RVMTYKTIPH; DVLKEVKSLK; KSLKTELAHK; SLKTELAHKK; ENINHPTITK; VVLYIAKTIK; VLYIAKTIKC; ILVGPTGVGK; GVGKTTTIAK; AIYGINGESK; TIDNYRIGAK; IPVRAIESFK; RAIESFKDLK; LVDTIGKSPK; PHLAVSSTTK; HLAVSSTTKT; SSTTKTSDVK; FHQFSPFNYK; HQFSPENYKT; FNYKTVIFTK; NLISLIYEMK; LISLIYEMKK; SVAEPLTFIR; RISDDAEFIK; RVMTYKTVPH (SEQ ID NOs: 4528-4553)
11mer: KENINHPTITK; AAIYGINGESK; AIYGINGESKS; ITIDNYRIGAK; TIDNYRIGAKK; IFHQFSPFNYK; RISDDAEFIKK (SEQ ID NOs: 4554-4560)
12mer: KKENINHPTITK; KENINHPTITKI; RVREDVVLYIAK; LAAIYGINGESK; IITIDNYRIGAK; ITIDNYRIGAKK; MGIPVRAIESFK; AEFHLAVSSTTK; EIFHQFSPFNYK (SEQ ID NOs: 4561-4569)

9mer: KNARVMTYK; GGILGLFSK; QQINVEDEK; NSSIEDVLK; VLKEVKSLK; SLKTELAHK; NINHPTITK; VLYIAKTIK; SGSIIDDLK; GSIIDDLKK; LVGPTGVGK; VGKTTTIAK; KIITIDNYR; AIESFKDLK; LILVDTIGK; HLAVSSTTK; STTKTSDVK; HQFSPFNYK; LISLIYEMK; ISLIYEMKK; ISDDAEFIK; SDDAEFIKK; SGSIIDNLK; GSIIDNLKK; SIIDNLKKR (SEQ ID NOs: 4570-4594)    A1101 TABLE C-4
10mer: IEIIKKKYGK; RVMTYKTIPH; HGGILGLFSK; SIEDVLKEVK; KSLKTELAHK; SLKTELAHKK; ENINHPTITK; YIKDINEFIK; VVLYIAKTIK; CSGSIIDDLK; SGSIIDDLKK; ILVGPTGVGK; GVGKTTTIAK; TTIAKLAAIY; AIYGINGESK; TIDNYRIGAK; IPVRAIESFK; RAIESFKDLK; LVDTIGKSPK; SSTTKTSDVK; FHQFSPFNYK; HQFSPFNYKT; FNYKTVIFTK; NLISLIYEMK; LISLIYEMKK; SVAEPLTFIR; LTFIRRINGY; RISDDAEFIK; ISDDAEFIKK; RVMTYKTVPH; CSGSIIDNLK; SGSIIDNLKK (SEQ ID NOs: 4595-4626)
11mer: SSIEDVLKEVK; KSLKTELAHKK; KENINHPTITK; AAIYGINGESK; ITIDNYRIGAK; TIDNYRIGAKK; TIGKSPKDFMK; IFHQFSPFNYK; NLISLIYEMKK; ISVAEPLTFIR; LTFIRRINGYR; YRISDDAEFIK; RISDDAEFIKK; CSGSIIDNLKK (SEQ ID NOs: 4627-4640)
12mer: NSSIEDVLKEVK; KKENINHPTITK; RVREDVVLYIAK; LAAIYGINGESK; IITIDNYRIGAK; ITIDNYRIGAKK; DTIGKSPKDFMK; AVSSTTKTSDVK; EIFHQFSPFNYK; IFHQFSPFNYKT; GNLISLIYEMKK; NISVAEPLTFIR; GYRISDDAEFIK; YRISDDAEFIKK; KCSGSIIDNLKK (SEQ ID NOs: 4641-4655)

9mer: TYNEVIEII; NYIKDINEF; ISVAEPLTF (SEQ ID NOs: 4656-4658)    A2402 TABLE C-5
10mer: TYKTIPHGGI; ENYIKDINEF; NYIKDINEFI; NYKTVIFTKV; TYKTVPHGGI (SEQ ID NOs: 4659-4663)
12mer: FSENYIKDINEF (SEQ ID NO: 4665)

9mer: EVIEIIKKK; TTIAKLAAI; DVKEIFHQF; EIFHQFSPF (SEQ ID NOs: 4666-4669)    A2501 TABLE C-6
10mer: EVIEIIKKKY (SEQ ID NO: 4670)

9mer: EVIEIIKKK; TTIAKLAAI; TIAKLAAIY; DVKEIFHQF; EIFHQFSPE    A2601 TABLE C-7
10mer: EVIEIIKKKY; ERVREDVVLY; TTIAKLAAIY; DTIGKSPKDF; EIFHQFSPFN; LTFIRRINGY (SEQ ID NOs: 4671-4681)
11mer: NEVIEIIKKKY; EVIEIIKKKYG; TTIAKLAAIYG; EIFHQFSPFNY (SEQ ID NOs: 4682-4685)
12mer: YNEVIEIIKKKY; NEVIEIIKKKYG; EVIEIIKKKYGK; DVKEIFHQFSPF; EIFHQFSPFNYK (SEQ ID NOs: 4686-4690)

9mer: YFTEKGPTY; VEVSGYVRY; FSLSDLDDY; RVREDVVLY; TIAKLAAIY; FHQFSPFNY; VGNLISLIY; NLISLIYEM; TFIRRINGY (SEQ ID NOs: 4691-4699)    A2902 TABLE C-8
10mer: QYFTEKGPTY; YFTEKGPTYN; WVEVSGYVRY; EFSLSDLDDY; TTIAKLAAIY; IFHQFSPFNY; FHQFSPFNYK; CVGNLISLIY; LTFIRRINGY (SEQ ID NOs: 4700-4708)
11mer: VQYFTEKGPTY; DWVEVSGYVRY; EIFHQFSPFNY; IFHQFSPFNYK (SEQ ID NOs: 4709-4712)
12mer: MVQYFTEKGPTY; KDWVEVSGYVRY; DYERVREDVVLY; KEIFHQFSPFNY; EIFHQFSPFNYK; IFHQFSPFNYKT (SEQ ID NOs: 4713-4718)

9mer: KKKYGKNAR; KNARVMTYK; VLKEVKSLK; ITKIEDILR; KDINEFIKR; KIITIDNYR; HQFSPFNYK; NYKTVIFTK; VAEPLTFIR; FIRRINGYR; SIIDNLKKR (SEQ ID NOs: 4719-4729)    A3101 TABLE C-9
10mer: RVMTYKTIPH; KSLKTELAHK; TITKIEDILR; SLSDLDDYER; IKIITIDNYR;

TABLE C-continued

Predicted MHC class 1 binding peptides P derived from Borrelia antigen
FlhF (8-, 9-, 10-, 11-, and 12-mers), predicted as detailed in Example 19.
The binding peptides P are sorted per HLA-allele.

KIITIDNYRI; IPVRAIESFK; RAIESFKDLK; KDEMKLAEMK; FHQFSPFNYK; FNYK
TVIFTK; SVAEPLTFIR; TFIRRINGYR; FIRRINGYRI; RVMTYKTVPH (SEQ ID
NOs: 4730-4744)
11mer: IIKKKYGKNAR; YIKDINEFIKR; NIKIITIDNYR; IFHQFSPFNYK; ISVAEP
LTFIR; LTFIRRINGYR; TFIRRINGYRI (SEQ ID NOs: 4745-4751)
12mer: EIIKKKYGKNAR; KYGKNARVMTYK; NYIKDINEFIKR; RVREDVVLYIAK; LN
IKIITIDNYR; MGIPVRAIESFK; EIFHQFSPFNYK; NISVAEPLTFIR; ISVAEPLTFI
RR; PLTFIRRINGYR; LTFIRRINGYRI (SEQ ID NOs: 4752-4762)

9mer: VVLYIAKTI; KTIKCSGSI; TTIAKLAAI; SLNIKIITI; QTYGDIMGI; RDAEF         A3201
HLAV; KTSDVKEIF; EIFHQFSPF; RINGYRISD (SEQ ID NOs: 4763-4771)              TABLE
10mer: KSLNIKIITI; KIITIDNYRI; KEIFHQFSPF; RVMTYKTVPH (SEQ                  C-10
NOs: 4772-4775)

9mer: YNEVIEIIK; EVIEIIKKK; EIIKKKYGK; KNARVMTYK; WVEVSGYVR; QQINV         A6801
EDEK; QINVEDEKR; NSSIEDVLK; NINHPTITK; ITKIEDILR; NDFSENYIK; LSDLD         TABLE
DYER; EDVVLYIAK; SGSIIDDLK; SIIDDLKKR; TIAKLAAIY; KIITIDNYR; DNYRI         C-11
GAKK; PVRAIESFK; AIESFKDLK; DFMKLAEMK; HLAVSSTTK; STTKTSDVK; HQFSP
FNYK; NYKTVIFTK; LISLIYEMK; ISLIYEMKK; VAEPLTFIR; FIRRINGYR; ISDDA
EFIK; DAEFIKKIK; SGSIIDNLK; SIIDNLKKR (SEQ ID NOs: 4776-4808)
10mer: NEVIEIIKKK; EVIEIIKKKY; DWVEVSGYVR; QQINVEDEKR; ENSSIEDVLK;
SIEDVLKEVK; DVLKEVKSLK; ENINHPTITK; TITKIEDILR; ENDFSENYIK; YIKD
INEFIK; SLSDLDDYER; VVLYIAKTIK; CSGSIIDDLK; TTIAKLAAIY; AIYGINGES
K; IKIITIDNYR; TIDNYRIGAK; IPVRAIESFK; RAIESFKDLK; DLILVDTIGK; LVD
TIGKSPK; PHLAVSSTTK; SSTTKTSDVK; FHQFSPENYK; FNYKTVIFTK; NLISLIYE
MK; LISLIYEMKK; SVAEPLTFIR; VAEPLTFIRR; TFIRRINGYR; RISDDAEFIK; CS
GSIIDNLK (SEQ ID NOs: 4809-4841)
11mer: PTITKIEDILR; NYIKDINEFIK; YIKDINEFIKR; NIKIITIDNYR; ISVAEP
LTFIR; SVAEPLTFIRR; LTFIRRINGYR (SEQ ID NOs: 4842-4848)
12mer: EVIEIIKKKYGK; EIIKKKYGKNAR; HPTITKIEDILR; ENYIKDINEFIK; NY
IKDINEFIKR; LNIKIITIDNYR; NIKIITIDNYRI; ITIDNYRIGAKK; QTYGDIMGIP
VR; MGIPVRAIESFK; DTIGKSPKDFMK; EIFHQFSPFNYK; NISVAEPLTFIR; ISVAE
PLTFIRR; PLTFIRRINGYR; LTFIRRINGYRI (SEQ ID NOs: 4849-4864)

9mer: KTIPHGGIL; IPHGGILGL; IPVRAIESF; SPFNYKTVI; KTVPHGGIL; VPHGG         B0702
ILGL (SEQ ID NOs: 4865-4870)                                              TABLE
10mer: TIPHGGILGL; IPHGGILGLF; FSPFNYKTVI; SPFNYKTVIF; TVPHGGILGL;         C-12
VPHGGILGLF (SEQ ID NOs: 4871-4876)
11mer: KTIPHGGILGL; SPKDFMKLAEM; VPHNISVAEPL; KTVPHGGILGL (SEQ
ID NOs: 4877-4880)

9mer: EFIKREFSL; DLKKRVFIL; SLNIKIITI; EIFHQFSPF; SPFNYKTVI; NLKKR         B0801
VFIL (SEQ ID NOs: 4881-4886)                                              TABLE
10mer: NEFIKREFSL; DDLKKRVFIL; DLKKRVFILV; FSPFNYKTVI; YEMKKVVSYV;         C-13
FIKKIKSKSY; DNLKKRVFIL; NLKKRVFILV (SEQ ID NOs: 4887-4894)
11mer: IDDLKKRVFIL; DNLKKRVFILV; NLKKRVFILVG (SEQ ID NOs: 4895-
4897)
12mer: IIDDLKKRVFIL; KSPKDEMKLAEM; IIDNLKKRVFIL; IDNLKKRVFILV; DN
LKKRVFILVG; NLKKRVFILVGP (SEQ ID NOs: 4898-4903)

9mer: YFTEKGPTY; IKKKYGKNA; KKYGKNARV; GKNARVMTY; ARVMTYKTI; VMTYK         B1503
TIPH; KTIPHGGIL; KDWVEVSGY; VEVSGYVRY; EKRKILQSI; IKREENSSI; KSLKT         TABLE
ELAH; INHPTITKI; RENDFSENY; IKREFSLSD; FSLSDLDDY; RVREDVVLY; KTIKC         C-14
SGSI; KKRVFILVG; GKTTTIAKL; TIAKLAAIY; AKLAAIYGI; SKSLNIKII; IKIIT
IDNY; GAKKQIQTY; KQIQTYGDI; IMGIPVRAI; RAIESFKDL; KSPKDFMKL; KDFMK
LAEM; MKLAEMKEL; KTSDVKEIF; EIFHQFSPF; FHQFSPFNY; HQFSPFNYK; YKTVI
FTKV; YEMKKVVSY; KKVVSYVTD; VSYVTDGQI; ISVAEPLTF; YRISDDAEF; IKKIK
SKSY; KKIKSKSYY; VMTYKTVPH; KTVPHGGIL (SEQ ID NOs: 4904-4948)
10mer: KKYGKNARVM; YGKNARVMTY; KQIQTYGDIM; KEIFHQFSPF; IKKIKSKSYY
(SEQ ID NOs: 4949-4953)
11mer: VQYFTEKGPTY; VKEIFHQFSPF; KEIFHQFSPFN (SEQ ID NOs: 4954-
4956)
12mer: MVQYFTEKGPTY; VQYFTEKGPTYN; KKYGKNARVMTY; DVKEIFHQFSPF; VK
EIFHQFSPFN; KEIFHQFSPFNY (SEQ ID NOs: 4957-4962)

9mer: VEVSGYVRY; RENDFSENY; DEITDSKDF; DETTCVGNL; YEMKKVVSY (SEQ          B1801
ID NOs: 4963-4967)                                                        TABLE
10mer: IYEMKKVVSY; YEMKKVVSYV (SEQ ID NOs: 4968-4969)                      C-15
11mer: YERVREDVVLY; LIYEMKKVVSY; IYEMKKVVSYV (SEQ ID NOs: 4970-
4972)
12mer: DYERVREDVVLY; DETTCVGNLISL; SLIYEMKKVVSY; LIYEMKKVVSYV
(SEQ ID NOs: 4973-4976)
9mer: YFTEKGPTY; IPHGGILGL; FSLSDLDDY; TIAKLAAIY; IPVRAIESF; NACGR         B3501
DAEF; EIFHQFSPF; VGNLISLIY; NLISLIYEM; YEMKKVVSY; VPHNISVAE; ISVAE         TABLE
PLTF; YRISDDAEF; VPHGGILGL (SEQ ID NOs: 4977-4990)                         C-16
10mer: SPFNYKTVIF (SEQ ID NOs: 4991)

TABLE C-continued

Predicted MHC class 1 binding peptides P derived from Borrelia antigen FlhF (8-, 9-, 10-, 11-, and 12-mers), predicted as detailed in Example 19. The binding peptides P are sorted per HLA-allele.

12mer: MVQYFTEKGPTY (SEQ ID NOs: 4992)

| | |
|---|---|
| 9mer: KENINHPTI; REFSLSDLD; YERVREDVV; REDVVLYIA; FDLILVDTI; KDFMK LAEM; AEMKELLNA; RDAEFHLAV; AEFHLAVSS; KEIFHQFSP; YEMKKVVSY (SEQ ID NOs: 4993-5003)<br>10mer: TEKGPTYNEV; REENSSIEDV; KEVKSLKTEL; KKENINHPTI; KENINHPTIT; RENDFSENYI; NEFIKREFSL; REFSLSDDD; YERVREDVVL; GESKSLNIKI; LAEM KELLNA; AEMKELLNAC; DAEFHLAVSS; AEFHLAVSST; KEIFHQFSPF; YEMKKVVSY V (SEQ ID NOs: 5004-5019)<br>11mer: RDAEFHLAVSS; DAEFHLAVSST; AEFHLAVSSTT; VKEIFHQFSPF; KEIFHQ FSPEN; IYEMKKVVSYV; YEMKKVVSYVT (SEQ ID NOs: 5020-5026)<br>12mer: REDVVLYIAKTI; RDAEFHLAVSST; DAEFHLAVSSTT; AEFHLAVSSTTK; DV KEIFHQFSPF; VKEIFHQFSPFN; KEIFHQFSPFNY; LIYEMKKVVSYV; IYEMKKVVSY VT; YEMKKVVSYVTD (SEQ ID NOs: 5027-5036) | B4002<br>TABLE<br>C-17 |
| 9mer: VEVSGYVRY; KENINHPTI; RENDFSENY; DEITDSKDF; AEMKELLNA; AEFHL AVSS; YEMKKVVSY (SEQ ID NOs: 5037-5043)<br>10mer: KKENINHPTI; LRENDFSENY; RENDFSENYI; KDEITDSKDF; AEMKELLNAC; AEFHLAVSST; KEIFHQFSPF; IYEMKKVVSY; YEMKKVVSYV; AEPLTFIRRI (SEQ ID NOs: 5044-5053)<br>11mer: SENYIKDINEF (SEQ ID NO: 5054)<br>12mer: FSENYIKDINEF; SENYIKDINEFI; SLIYEMKKVVSY; AEFIKKIKSKSY (SEQ ID NOs: 5055-5058) | B4402<br>TABLE<br>C-18 |
| 9mer: EENSSIEDV; KENINHPTI; REDVVLYIA; AEMKELLNA; AEFHLAVSS (SEQ ID NOs: 5059-5063)<br>10mer: TEKGPTYNEV; RENDFSENYI; VREDVVLYIA; REDVVLYIAK; LAEMKELLNA; AEMKELLNAC; DAEFHLAVSS; AEFHLAVSST; YEMKKVVSYV; AEPLTFIRRI (SEQ ID NOs: 5064-5073)<br>11mer: KLAEMKELLNA; LAEMKELLNAC; AEMKELLNACG; DAEFHLAVSST; AEFHLA VSSTT (SEQ ID NOs: 5074-5078)<br>12mer: MKLAEMKELLNA; KLAEMKELLNAC; LAEMKELLNACG; AEMKELLNACGR; RD AEFHLAVSST; DAEFHLAVSSTT (SEQ ID NOs: 5079-5084) | B4501<br>TABLE<br>C-19 |
| 9mer: EPLTFIRRI (SEQ ID NO: 5085)<br>10mer: FSPFNYKTVI (SEQ ID NO: 5086) | B5101<br>TABLE<br>C-20 |

Preferred binding peptides P derived or predicted from *Borrelia* protein FlaB capable of interacting with one or more MHC class 1 molecules are listed in Table 0:

TABLE D

Predicted MHC class 1 binding peptides P derived from Borrelia antigen FlaB (8-, 9-, 10-, 11-, and 12-mers), predicted as detailed in Example 20. The binding peptides P are sorted per HLA-allele.

FlaB antigenic polypeptide sequences

BORRELIA AFZELLI.PKO (SEQ ID NO: 29)

BORRELIA AFZELLI.9W10-04 (SEQ ID NO: 30)

BORRELIA AFZELLI.P-GAU (SEQ ID NO: 31)

BORRELIA AFZELLI.VS461 (SEQ ID NO: 32)

BORRELIA GARINII.PBI (SEQ ID NO: 33)

BORRELIA GARINII.BGVIR (SEQ ID NO: 34)

BORRELIA GARINII.20047 (SEQ ID NO: 35)

BORRELIA BURGDORFERI.A1 (SEQ ID NO: 36)

BORRELIA BURGDORFERI.CA8 (SEQ ID NO: 37)

| Predicted FlaB antigenic peptides P | HLA-allele |
|---|---|
| 9mer: TVDANTSLA; MTDEVVAAT (SEQ ID NOs: 5087-5088)<br>10mer: KTQEKLSSGY; YSANVANLFA; TTVDANTSLA (SEQ ID NOs: 5089- | A0101<br>TABLE |

TABLE D-continued

Predicted MHC class 1 binding peptides P derived from Borrelia antigen FlaB (8-, 9-, 10-, 11-, and 12-mers), predicted as detailed in Example 20. The binding peptides P are sorted per HLA-allele.

| | |
|---|---|
| 5091)<br>11mer: TTTVDANTSLA (SEQ ID NO: 5092)<br>12mer: LSKTQEKLSSGY; VTTTVDANTSLA (SEQ ID NOs: 5093-5094) | D-1 |
| 9mer: MIINHNTSA; QLTDEINRI; AQYNQMHML; SQASWTLRV; AIAVNIYSA; AVNIY SANV; AQAAQAAPV; TQGGVNSPV; SLAKIENAI; NLGAFQNRL; TMTDEVVAA; MTDEV VAAT; SAMAMIAQA; AMIAQANQV; KINAQITGL; AIAVNIYAA; SQAAQTAPV; SQGGV NSPV; MTDEVVAST; AQAAQTAPV; AQTAQAAPV; SIQIEIEQL; NLNEVEKVL (SEQ ID NOs: 5095-5117)<br>10mer: NLNEVEKVLV; VLVRMKELAV; GSQASWTLRV; ILTQSAMAMI; MAMIAQANQV; AQANQVPQYV; TVDANTSLAK (SEQ ID NOs: 5118-5124)<br>11mer: SLSGSQASWTL (SEQ ID NO: 5125)<br>12mer: IQIEIEQLTDEI; RMISDQRANLGA; AQIKDATMTDEV (SEQ ID NOs: 5126-5128) | A0201<br>TABLE<br>D-2 |
| 9mer: AINAANLSK; AAGMGVSGK; SQASRNTSK; NQMHMLSNK; SINAANLSK; GINAA NLSK (SEQ ID NOs: 5129-5134)<br>10mer: NAINAANLSK; AINAANLSKT; KLSSGYRINR; LSQASRNTSK; YNQMHMLSNK; TVDANTSLAK; STEYAIENLK; NLKASYAQIK; VPQYVLSLLR; NSINAANLSK; SINA ANLSKT; NGINAANLSK; GINAANLSKT (SEQ ID NOs: 5135-5147)<br>11mer: GLSQASRNTSK; TTVDANTSLAK (SEQ ID NOs: 5148-5149)<br>12mer: RNNAINAANLSK; AQYNQMHMLSNK; MLSNKSASQNVK; KTAEELGMQPAK; TT TVDANTSLAK; RNNSINAANLSK; RTAEELGMQPAK; RNNGINAANLSK (SEQ ID NOs: 5150-5157) | A0301<br>TABLE<br>D-3 |
| 9mer: NTSAINASR; AINAANLSK; LSSGYRINR; AAGMGVSGK; SQASRNTSK; NQMHM LSNK; GSQASWTLR; SINAANLSK; GINAANLSK (SEQ ID NOs: 5158-5166)<br>10mer: HNTSAINASR; NAINAANLSK; AINAANLSKT; AANLSKTQEK; KLSSGYRINR; LSQASRNTSK; YNQMHMLSNK; SGSQASWTLR; TVDANTSLAK; STEYAIENLK; VPQY VLSLLR; NSINAANLSK; SINAANLSKT; NGINAANLSK; GINAANLSKT (SEQ ID NOs: 5167-5181)<br>11mer: NNAINAANLSK; TTEGNLNEVEK; TTVDANTSLAK; NSTEYAIENLK; STEYAI ENLKA; NNSINAANLSK; DSTEYAIENLK (SEQ ID NOs: 5182-5188)<br>12mer: RNNAINAANLSK; AQYNQMHMLSNK; KTAEELGMQPAK; TTTVDANTSLAK; TT VDANTSLAKI; KNSTEYAIENLK; NSTEYAIENLKA; RNNSINAANLSK; RTAEELGMQP AK; KDSTEYAIENLK; DSTEYAIENLKA; RNNGINAANLSK (SEQ ID NOs: 5189-5200) | A1101<br>TABLE<br>D-4 |
| 9mer: IYSANVANL; YSANVANLF; IYAANVANL; YAANVANLF (SEQ ID NOs: 5201-5204)<br>10mer: NIYSANVANL; IYSANVANLF; NIYAANVANL; IYAANVANLF (SEQ ID NOs: 5205-5208)<br>11mer: NIYSANVANLF; IYSANVANLFA; NIYAANVANLF; IYAANVANLFS (SEQ ID NOs: 5209-5212)<br>12mer: VNIYSANVANLF; NIYSANVANLFA; IYSANVANLFAG; VNIYAANVANLF; NI YAANVANLES; IYAANVANLESG (SEQ ID NOs: 5213-5218) | A2402<br>TABLE<br>D-5 |
| 9mer: ESIKNSTEY; ESIKDSTEY (SEQ ID NOs: 5219-5220) | A2501<br>TABLE<br>D-6 |
| 9mer: YSANVANLF; ESIKNSTEY; YAANVANLF; ESIKDSTEY (SEQ ID NOs: 5221-5224)<br>10mer: ESIKNSTEYA; YAIENLKASY (SEQ ID NOs: 5225-5226)<br>11mer: EYAIENLKASY; YAIENLKASYA (SEQ ID NOs: 5227-5228)<br>12mer: YAIENLKASYAQ (SEQ ID NO: 5229) | A2601<br>TABLE<br>D-7 |
| 9mer: AVQSGNGTY; YSANVANLF; YAANVANLF (SEQ ID NOs: 5230-5232)<br>10mer: INRIADQAQY; IYSANVANLF; YAIENLKASY; IYAANVANLF (SEQ ID NOs: 5233-5236)<br>12mer: AMIAQANQVPQY (SEQ ID NO: 5237) | A2902<br>TABLE<br>D-8 |
| 9mer: NTSAINASR; LSSGYRINR; NQMHMLSNK; GSQASWTLR; ASWTLRVHV; LAKIE NAIR; AIRMISDQR; ANLGAFQNR; ITGLSQASR (SEQ ID NOs: 5238-5246)<br>10mer: HNTSAINASR; TQEKLSSGYR; KLSSGYRINR; VSGKINAQIR; QIRGLSQASR; SGSQASWTLR; GSQASWTLRV; SLAKIENAIR; NAIRMISDQR; RANLGAFQNR; STEY AIENLK; VPQYVLSLLR (SEQ ID NOs: 5247-5258)<br>11mer: NHNTSATNASR; KTQEKLSSGYR; EKLSSGYRINR; LSGSQASWTLR; QRANLG AFQNR (SEQ ID NOs: 5259-5263)<br>12mer: INHNTSAINASR; SKTQEKLSSGYR; KTQEKLSSGYRI; QEKLSSGYRINR; SL SGSQASWTLR; DQRANLGAFQNR (SEQ ID NOs: 5264-5269) | A3101<br>TABLE<br>D-9 |
| 9mer: IINHNTSAI; KINAQIRGL; SLAKIENAI; KIENAIRMI; VVAATTNSI; KINAQ ITGL; VVASTTNSI (SEQ ID NOs: 5270-5276)<br>10mer: MIINHNTSAI (SEQ ID NO: 5277) | A3201<br>TABLE<br>D-10 |

TABLE D-continued

Predicted MHC class 1 binding peptides P derived from Borrelia antigen FlaB (8-, 9-, 10-

TABLE D-continued

Predicted MHC class 1 binding peptides P derived from Borrelia antigen FlaB (8-, 9-, 10-, 11-, and 12-mers), predicted as detailed in Example 20. The binding peptides P are sorted per HLA-allele.

| | |
|---|---|
| 10mer: MAMIAQANQV (SEQ ID NO: 5501) | B5101 TABLE D-20 |

Preferred binding peptides P derived or predicted from *Borrelia* protein P37-42 capable of interacting with one or more MHC class 1 molecules are listed in Table E:

TABLE E

Predicted MHC class 1 binding peptides P derived from Borrelia antigen P37-42 (8-, 9-, 10-, 11-, and 12-mers), predicted as detailed in Example 21. The binding peptides P are sorted per HLA-allele.

P37-42 antigenic polypeptide sequences

BORRELIA GARINII P37 noname. (SEQ ID NO: 38)

BORRELIA BURGDORFERI P37 noname. (SEQ ID NO: 39)

| Predicted P37-42 antigenic peptides P | HLA-allele |
|---|---|
| 10mer: NLDEFAQEEY (SEQ ID NO: 5502)<br>11mer: ANLDEFAQEEY; NLDEFAQEEYE (SEQ ID NOs: 5503-5504)<br>12mer: KANLDEFAQEEY; ANLDEFAQEEYE (SEQ ID NOs: 5505-5506) | A0101 TABLE E-1 |
| 9mer: RLCLIKIFI; KIFIIPNLV; FIIPNLVFS; NLVFSSLFL; FLFESCSGF; KTYDP ILQV; SLPNSSPAI; TIMPKLQEM; KLQEMRSFM; MLDEAKDKL; FASACIEYT; YTQKA IDYL (SEQ ID NOs: 5507-5518)<br>10mer: MRLCLIKIFI; RLCLIKIFII; LIKIFIIPNL; IKIFIIPNLV; FIIPNLVFSS; IIPNLVFSSL; LFLFESCSGF; FLFESCSGFL; KKTYDPILQV; LLEFEKDYET; TLSN LLFSNL; FMEQATNSWI; KLAESIYKRL (SEQ ID NOs: 5519-5531)<br>11mer: FIIPNLVFSSL; LFLFESCSGFL; FLFESCSGFLS; ETLSNLLFSNL; LLFSNL DTSPL; DKLAESIYKRL (SEQ ID NOs: 5532-5537)<br>12mer: IFIIPNLVFSSL; SLFLFESCSGFL; LFLFESCSGFLS; FLFESCSGFLSK; FL SKKSIEQFAL; TLLEFEKDYETL; YETLSNLLFSNL; NLLFSNLDTSPL; KDKLAESIYK RL; KLQEMRSFMEQA; YLQQGNSCKKEI (SEQ ID NOs: 5538-5548) | A0201 TABLE E-2 |
| 9mer: ALKDHQENK; ATNSWISAK; KLAESIYKR; RLYNGNSYR (SEQ ID NOs: 5549-5552)<br>10mer: FESCSGFLSK; SIEQFALALK; KNTTNTSADK; IVNHANPENK; NLDTSPLNRK; QATNSWISAK; ATNSWISAKG; KRLYNGNSYR; RLYNGNSYRF; ASACIEYTQK (SEQ ID NOs: 5553-5562)<br>11mer: KSIEQFALALK; HMSDDPGANNK; KLNNTLLEFEK; ISAKGMLDEAK; YKRLYN GNSYR; KRLYNGNSYRF (SEQ ID NOs: 5563-5568)<br>12mer: FLFESCSGFLSK; QHMSDDPGANNK; NKLNNTLLEFEK; KLNNTLLEFEKD; ME QATNSWISAK; WISAKGMLDEAK; IYKRLYNGNSYR; YKRLYNGNSYRF; KRLYNGNSYR FG (SEQ ID NOs: 5569-5577) | A0301 TABLE E-3 |
| 9mer: ESCSGFLSK; ALKDHQENK; NTTNTSADK; NTSADKNSK; ATNSWISAK; KLAES IYKR; RLYNGNSYR; SACIEYTQK; LQQGNSCKK (SEQ ID NOs: 5578-5586)<br>10mer: FESCSGFLSK; ESCSGFLSKK; SIEQFALALK; KNTTNTSADK; TNTSADKNSK; KNSKE IESPK; MSDDPGANNK; IVNHANPENK; TIMPKLQEMR; QATNSWISAK; ATNSWISAKG; SAKGMLDEAK; KDKLAESIYK; KRLYNGNSYR; ASACIEYTQK (SEQ ID NOs: 5587-5601)<br>11mer: LFESCSGELSK; KSIEQFALALK; TTNTSADKNSK; AQNNVKMEENK; KLNNTL LEFEK; EQATNSWISAK; ISAKGMLDEAK; FASACIEYTQK (SEQ ID NOs: 5602-5609)<br>12mer: FLFESCSGFLSK; KKSIEQFALALK; NTTNTSADKNSK; HAQNNVKMEENK; NK LNNTLLEFEK; MEQATNSWISAK; WISAKGMLDEAK; GSFNGRDMQHAK; DFASACIEYT QK (SEQ ID NOs: 5610-5618) | A1101 TABLE E-4 |
| 9mer: IFIIPNLVF; LVFSSLFLF; LYNGNSYRF (SEQ ID NOs: 5619-5621)<br>10mer: KIFIIPNLVF; KDYETLSNLL; DYETLSNLLF; SFMEQATNSW; RLYNGNSYRF; LYNGNSYRFG (SEQ ID NOs: 5622-5627)<br>11mer: KRLYNGNSYRF; RLYNGNSYRFG; LYNGNSYRFGG (SEQ ID NOs: 5628-5630)<br>12mer: YKRLYNGNSYRF; KRLYNGNSYRFG; RLYNGNSYRFGG; LYNGNSYRFGGS (SEQ ID NOs: 5631-5634) | A2402 TABLE E-5 |

TABLE E-continued

Predicted MHC class 1 binding peptides P derived from Borrelia antigen P37-42 (8-, 9-, 10-, 11-, and 12-mers), predicted as detailed in Example 21. The binding peptides P are sorted per HLA-allele.

9mer: EIKANLDEF (SEQ ID NO: 5635)      A2501 TABLE E-6

9mer: FLFESCSGF; EIKANLDEF (SEQ ID NOs: 5636-5637)      A2601 TABLE E-7

9mer: IFIIPNLVF; LVFSSLFLF; FLFESCSGF; TLLEFEKDY; LYNGNSYRF; MQHAK NLAY; DEASACIEY (SEQ ID NOs: 5638-5644)
10mer: NLVFSSLFLF; LVFSSLFLFE; RLYNGNSYRF; DMQHAKNLAY; IDFASACIEY
11mer: AIDFASACIEY (SEQ ID NOs: 5645-5649)
12mer: IPNLVFSSLFLF; YKRLYNGNSYRF; RAIDFASACIEY (SEQ ID NOs: 5650-5652)
     A2902 TABLE E-8

9mer: IMPKLQEMR; KLQEMRSFM; ATNSWISAK; KLAESIYKR; RLYNGNSYR; RFGGS FNGR; QHAKNLAYR (SEQ ID NOs: 5653-5660)
10mer: KNSKEIESPK; TIMPKLQEMR; QATNSWISAK; DKLAESIYKR; KRLYNGNSYR; RLYNGNSYRF; YRFGGSFNGR; RFGGSFNGRD; MQHAKNLAYR; ASACIEYTQK (SEQ ID NOs: 5661-5670)
11mer: KTIMPKLQEMR; DKDLAESIYKR; YKRLYNGNSYR; KRLYNGNSYRF; SYRFGG SFNGR; DMQHAKNLAYR; MQHAKNLAYRA (SEQ ID NOs: 5671-5677)
12mer: IKTIMPKLQEMR; MEQATNSWISAK; AKDKLAESIYKR; IYKRLYNGNSYR; YK RLYNGNSYRF; KRLYNGNSYRFG; NSYRFGGSFNGR; RDMQHAKNLAYR; DMQHAKNLAY RA; MQHAKNLAYRAI (SEQ ID NOs: 5678-5687)
     A3101 TABLE E-9

9mer: RLCLIKIFI; KIFIIPNLV; LVFSSLFLF; SIEQFALAL; KTYDPILQV; KLNNT LLEF; FMEQATNSW; MQHAKNLAY (SEQ ID NOs: 5688-5695)
10mer: KIFIIPNLVF; RLYNGNSYRF (SEQ ID NOs: 5696-5697)
11mer: RSFMEQATNSW; KRLYNGNSYRF; RLYNGNSYRFG (SEQ ID NOs: 5698-5700)
     A3201 TABLE E-10

9mer: LVFSSLFLF; ESCSGFLSK; NTTNTSADK; NTSADKNSK; NSKEIESPK; DSHAQ NNVK; NNVKMEENK; EQTSLSEIK; NNTLLEFEK; IMPKLQEMR; ATNSWISAK; KLAES IYKR; RLYNGNSYR; QHAKNLAYR; SACIEYTQK (SEQ ID NOs: 5701-5715)
10mer: NLVFSSLFLF; FESCSGELSK; ESCSGFLSKK; SIEQFALALK; KNTTNTSADK; TNTSADKNSK; IVNHANPENK; DTSPLNRKIK; TIMPKLQEMR; QATNSWISAK; SAKG MLDEAK; DKLAESIYKR; KRLYNGNSYR; YRFGGSFNGR; MQHAKNLAYR; FASACIEYT Q; ASACIEYTQK (SEQ ID NOs: 5716-5732)
11mer: KTIMPKLQEMR; YKRLYNGNSYR; FASACIEYTQK (SEQ ID NOs: 5733-5735)
12mer: IKTIMPKLQEMR; MEQATNSWISAK; IYKRLYNGNSYR; NSYRFGGSFNGR; DF ASACIEYTQK (SEQ ID NOs: 5736-5740)
     A6801 TABLE E-11

9mer: IPNLVFSSL; LPNSSPAII (SEQ ID NOs: 5741-5742)
10mer: IIPNLVFSSL; IPNLVFSSLF; NPENKLNNTL; SPLNRKIKTI; MPKLQEMRSF (SEQ ID NOs: 5743-5747)
11mer: SPLNRKIKTIM; MPKLQEMRSFM (SEQ ID NOs: 5748-5749)
12mer: TSPLNRKIKTIM; SPLNRKIKTIMP; IMPKLQEMRSFM; MPKLQEMRSFME (SEQ ID NOs: 5750-5753)
     B0702 TABLE E-12

9mer: IPNLVFSSL; LNRKIKTIM; TIMPKLQEM (SEQ ID NOs: 5754-5756)
10mer: SPLNRKIKTI; MPKLQEMRSF (SEQ ID NOs: 5757-5758)
12mer: FLSKKSIEQFAL; IMPKLQEMRSFM (SEQ ID NOs: 5759-5760)
     B0801 TABLE E-13

9mer: MRLCLIKIF; IFIIPNLVF; PNLVFSSLF; LVFSSLFLF; FLFESCSGF; LSKKS IEQF; KKSIEQFAL; VTSSNKKTY; SNKKTYDPI; NKKTYDPIL; KTYDPILQV; LQVGS NQHM; NQHMSDDPG; SLPNSSPAI; IQNDSHAQN; STTPQHDPI; EQSNFKNSL; FKNSL TTTS; YEQTSLSEI; KLNNTLLEF; KDYETLSNL; YETLSNLLF; LSNLLFSNL; FSNLD TSPL; RKIKTIMPK; PKLQEMRSF; KLQEMRSFM; RSFMEQATN; FMEQATNSW; AKDKL AESI; KRLYNGNSY; NSYRFGGSF; MQHAKNLAY; AKNLAYRAI; NLAYRAIDF; RAIDF ASAC; CKKEIENIF (SEQ ID NOs: 5761-5797)
10mer: FLSKKSIEQF; RKIKTIMPKL; YKRLYNGNSY; RLYNGNSYRF; DMQHAKNLAY; MQHAKNLAYR (SEQ ID NOs: 5798-5803)
11mer: IYKRLYNGNSY; YKRLYNGNSYR; KRLYNGNSYRF; RDMQHAKNLAY (SEQ ID NOs: 5804-5807)
12mer: SIYKRLYNGNSY; IYKRLYNGNSYR; YKRLYNGNSYRF; GRDMQHAKNLAY; RD MQHAKNLAYR (SEQ ID NOs: 5808-5812)
     B1503 TABLE E-14

9mer: FESCSGFLS; YEQTSLSEI; YETLSNLLF; DEAKDKLAE; AESIYKRLY; DFASA CIEY; KEIENIFKL (SEQ ID NOs: 5813-5819)
10mer: DYETLSNLLF; IEYTQKAIDY (SEQ ID NOs: 5820-5821)
11mer: CIEYTQKAIDY (SEQ ID NO: 5822)
12mer: DEAKDKLAESIY; ACIEYTQKAIDY (SEQ ID NOs: 5823-5824)
     B1801 TABLE E-15

TABLE E-continued

Predicted MHC class 1 binding peptides P derived from Borrelia antigen P37-42 (8-, 9-, 10-, 11-, and 12-mers), predicted as detailed in Example 21. The binding peptides P are sorted per HLA-allele.

```
9mer: IPNLVFSSL; LVFSSLFLF; FLFESCSGF; LPNSSPAII; FSNLDTSPL; FMEQA         B3501
TNSW; LYNGNSYRF; MQHAKNLAY; DFASACIEY (SEQ ID NOs: 5825-5833)              TABLE
10mer: IPNLVFSSLF; MPKLQEMRSF (SEQ ID NOs: 5834-5835)                      E-16

9mer: QENKNTTNT; KEIESPKDV; KESLPNSSP; SEEEIKANL; QEEYEQTSL; YEQTS          B4002
LSEI; SEIKNATQI; PENKLNNTL; LEFEKDYET; KDYETLSNL; YETLSNLLF; QEMRS          TABLE
FMEQ; MEQATNSWI; RDMQHAKNL; KEIENIFKL (SEQ ID NOs: 5836-5850)               E-17
10mer: KESLPNSSPA; IEQSNFKNSL; EYEQTSLSEI; YEQTSLSEIK; LSEIKNATQI;
SEIKNATQIV; NPENKLNNTL; PENKLNNTLL; LLEFEKDYET; LEFEKDYETL; QEMR
SFMEQA; KKEIENIFKL (SEQ ID NOs: 5851-5862)
11mer: KESLPNSSPAI; ANPENKLNNTL; LLEFEKDYETL; LEFEKDYETLS; FEKDYE
TLSNL; CKKEIENIFKL (SEQ ID NOs: 5863-5868)
12mer: HANPENKLNNTL; ANPENKLNNTLL; TLLEFEKDYET; YETLSNLLESNL; SC
KKEIENIFKL (SEQ ID NOs: 5869-5873)

9mer: YEQTSLSEI; SEIKNATQI; YETLSNLLF; QEMRSFMEQ; MEQATNSWI; AESIY          B4402
KRLY (SEQ ID NOs: 5874-5879)                                               TABLE
10mer: EEIKANLDEF; EYEQTSLSEI; SEIKNATQIV; NPENKLNNTL; DYETLSNLLF;          E-18
YETLSNLLFS; QEMRSFMEQA; SFMEQATNSW; FMEQATNSWI; MEQATNSWIS; LAES
IYKRLY; AESIYKRLYN; IEYTQKAIDY (SEQ ID NOs: 5880-5892)

9mer: QENKNTTNT; YEQTSLSEI; SEIKNATQI; QEMRSFMEQ; MEQATNSWI (SEQ            B4501
ID NOs: 5893-5897)                                                         TABLE
10mer: KESLPNSSPA; SEIKNATQIV; QEMRSFMEQA; MEQATNSWIS (SEQ ID               E-19
NOs: 5898-5901)
11mer: QENKNTTNTSA; LQEMRSFMEQA; QEMRSFMEQAT; MEQATNSWISA (SEQ
ID NOs: 5902-5905)
12mer: HQENKNTTNTSA; KLQEMRSFMEQA; LQEMRSFMEQAT; QEMRSFMEQATN; FM
EQATNSWISA; MEQATNSWISAK (SEQ ID NOs: 5906-5911)

9mer: LPNSSPAII (SEQ ID NO: 5912)                                          B5101
                                                                           TABLE
                                                                           E-20
```

In one embodiment there is provided a panel comprising one or more MHC multimers, wherein each of said one or more MHC multimers comprise an antigenic peptide P selected from the group consisting of:
- i) antigenic peptides P derived from *Borrelia* antigenic polypeptide OppA (SEQ ID NOs:1-9) listed in Table A (Table A-1 to Table A-20),
- ii) antigenic peptides P derived from *Borrelia* antigenic polypeptide DbpA (SEQ ID NOs:10-20) listed in Table B (Table B-1 to Table B-19),
- iii) antigenic peptides P derived from *Borrelia* antigenic polypeptide FlhF (SEQ ID NOs:21-28) listed in Table C (Table C-1 to Table C-20),
- iv) antigenic peptides P derived from *Borrelia* antigenic polypeptide FlaB (SEQ ID NOs:29-37) listed in Table D (Table D-1 to Table D-20), and/or
- v) antigenic peptides P derived from *Borrelia* antigenic polypeptide P37-42 (SEQ ID NOS:38-39) listed in Table E (Table E-1 to Table E-20).

In one embodiment there is provided a panel comprising one or more MHC multimers, wherein each of said one or more MHC multimers comprise an antigenic peptide P selected from the group consisting of:
- i) antigenic peptides P derived from *Borrelia* antigenic polypeptide OppA (SEQ ID NOs:1-9) listed in Table A-1, Table A-2, Table A-3, Table A-4, Table A-5, Table A-6, Table A-7, Table A-8, Table A-9, Table A-10, Table A-11, Table A-12, Table A-13, Table A-14, Table A-15, table A-16, Table A-17, Table A-18, Table A-19, or Table A-20,
- ii) antigenic peptides P derived from *Borrelia* antigenic polypeptide DbpA (SEQ ID NOs:10-20) listed in Table B-1, Table B-2, Table B-3, Table B-4, Table B-5, Table B-6, Table B-7, Table B-8, Table B-9, Table B-10, Table B-11, Table B-12, Table B-13, Table B-14, Table B-15, table B-16, Table B-17, Table B-18, or Table B-19,
- iii) antigenic peptides P derived from *Borrelia* antigenic polypeptide FlhF (SEQ ID NOs:21-28) listed in Table C-1, Table C-2, Table C-3, Table C-4, Table C-5, Table C-6, Table C-7, Table C-8, Table C-9, Table C-10, Table C-11, Table C-12, Table C-13, Table C-14, Table C-15, table C-16, Table C-17, Table C-18, Table C-19, or Table C-20,
- iv) antigenic peptides P derived from *Borrelia* antigenic polypeptide FlaB (SEQ ID NOs:29-37) listed in Table D-1, Table D-2, Table D-3, Table D-4, Table D-5, Table D-6, Table D-7, Table D-8, Table D-9, Table D-10, Table D-11, Table D-12, Table D-13, Table D-14, Table D-15, table D-16, Table D-17, Table D-18, Table D-19, or Table D-20, and/or
- v) antigenic peptides P derived from *Borrelia* antigenic polypeptide P37-42 (SEQ ID NOS:38-39) listed in Table E-1, Table E-2, Table E-3, Table E-4, Table E-5, Table E-6, Table E-7, Table E-8, Table E-9, Table E-10, Table E-11, Table E-12, Table E-13, Table E-14, Table E-15, table E-16, Table E-17, Table E-18, Table E-19, or Table E-20.

In one embodiment there is provided a panel comprising one or more MHC multimers, wherein each of said one or more MHC multimers comprise an antigenic peptide P selected from the group consisting of:

|  | (SEQ ID NO: 359) |
|---|---|
| YLNTKSNGNYEI, | |
| FLSIFTQGYT, | (SEQ ID NO: 241) |
| GIYDLILNA, | (SEQ ID NO: 2761) |
| YIKDINEFI, | (SEQ ID NO: 4479) |
| IQIEIEQLTDEI, | (SEQ ID NO: 5126) |
| RMISDQRANLGA, | (SEQ ID NO: 5127) |
| SQGGVNSPV, | (SEQ ID NO: 5112) |
| MLDEAKDKL, | (SEQ ID NO: 5516) |
| FMEQATNSWI, | (SEQ ID NO: 5530) |
| NLVFSSLFL and | (SEQ ID NO: 5510) |
| KLAESIYKRL. | (SEQ ID NO: 5531) |

In one embodiment there is provided a panel comprising one or more MHC multimers, wherein each of said one or more MHC multimers comprise an antigenic peptide P selected from the group consisting of:
i) YLNTKSNGNYEI (SEQ ID NO: 359) and FLSIFTQGYT (SEQ ID NO: 241)derived from OppA,
ii) GIYDLILNA (SEQ ID NO: 2761) derived from DbpA,
iii) YIKDINEFI (SEQ ID NO: 4479) derived from FlhF,
iv) IQIEIEQLTDEI (SEQ ID NO: 5126), RMISDQRANLGA (SEQ ID NO: 5127) and SQGGVNSPV (SEQ ID NO: 5112) derived from FlaB, and/or
v) IQIEIEQLTDEI (SEQ ID NO: 5126), MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531) derived from P37-42.

In one embodiment there is provided a panel comprising one or more MHC multimers, wherein each of said one or more MHC multimers comprise an antigenic peptide P selected from the group consisting of:
i) YLNTKSNGNYEI (SEQ ID NO: 359) derived from OppA, FLSIFTQGYT (SEQ ID NO: 241) derived from OppA, GIYDLILNA (SEQ ID NO: 2761) derived from DbpA, and YIKDINEFI (SEQ ID NO: 4479) derived from FlhF,
ii) IQIEIEQLTDEI (SEQ ID NO: 5126), RMISDQRANLGA (SEQ ID NO: 5127) and SQGGVNSPV (SEQ ID NO: 5112) derived from FlaB, and/or
iii) IQIEIEQLTDEI (SEQ ID NO: 5126), MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531) derived from P37-42.

In one embodiment there is provided a panel comprising or consisting of 11 MHC multimers wherein each of said 11 MHC multimers comprise an antigenic peptide P selected from the group consisting of:

In one embodiment there is provided a panel comprising or consisting of an MHC multimer comprising YLNTKSNGNYEI (SEQ ID NO: 359), an MHC multimer comprising FLSIFTQGYT (SEQ ID NO: 241), an MHC multimer comprising GIYDLILNA (SEQ ID NO: 2761), an MHC multimer comprising YIKDINEFI (SEQ ID NO: 4479), an MHC multimer comprising IQIEIEQLTDEI (SEQ ID NO: 5126), an MHC multimer comprising RMISDQRANLGA (SEQ ID NO: 5127), an MHC multimer comprising SQGGVNSPV (SEQ ID NO: 5112), an MHC multimer comprising MLDEAKDKL (SEQ ID NO: 5516), an MHC multimer comprising FMEQATNSWI (SEQ ID NO: 5530), an MHC multimer comprising NLVFSSLFL (SEQ ID NO: 5510) and an MHC multimer comprising KLAESIYKRL (SEQ ID NO: 5531).

In one embodiment there is provided a panel comprising one or more pools, or two or more pools, of MHC multimers, wherein each pool comprises one or more MHC multimers each comprising:
i) an antigenic peptide P derived from *Borrelia* antigenic polypeptide OppA (SEQ ID NOs:1-9) listed in Table A (Table A-1 to Table A-20),
ii) an antigenic peptide P derived from *Borrelia* antigenic polypeptide DbpA (SEQ ID NOs:10-20) listed in Table B (Table B-1 to Table B-19),
iii) an antigenic peptide P derived from *Borrelia* antigenic polypeptide FlhF (SEQ ID NOs:21-28) listed in Table C (Table C-1 to Table C-20),
iv) an antigenic peptide P derived from *Borrelia* antigenic polypeptide FlaB (SEQ ID NOs:29-37) listed in Table D (Table D-1 to Table D-20), and/or
v) an antigenic peptide P derived from *Borrelia* antigenic polypeptide P37-42 (SEQ ID NOS:38-39) listed in Table E (Table E-1 to Table E-20).

In one embodiment there is provided a panel comprising one or more pools, or two or more pools, of MHC multimers, wherein each pool comprises one or more MHC multimers each comprising:

i) an antigenic peptide P derived from *Borrelia* antigenic polypeptide OppA (SEQ ID NOs:1-9) listed in Table A (Table A-1 to Table A-20), and including at least one or both of YLNTKSNGNYEI (SEQ ID NO: 359) and FLSIFTQGYT (SEQ ID NO: 241);

ii) an antigenic peptide P derived from *Borrelia* antigenic polypeptide DbpA (SEQ ID NOs:10-20) listed in Table B (Table B-1 to Table B-19), and including at least GIYDLILNA (SEQ ID NO: 2761);

iii) an antigenic peptide P derived from *Borrelia* antigenic polypeptide FlhF (SEQ ID NOs:21-28) listed in Table C (Table C-1 to Table C-20), and including at least YIKDINEFI (SEQ ID NO: 4479);

iv) an antigenic peptide P derived from *Borrelia* antigenic polypeptide FlaB (SEQ ID NOs:29-37) listed in Table D (Table D-1 to Table D-20), and including at least one or more of IQIEIEQLTDEI (SEQ ID NO: 5126), RMISDQRANLGA (SEQ ID NO: 5127) and SQGGVNSPV (SEQ ID NO: 5112); and/or v) an antigenic peptide P derived from *Borrelia* antigenic polypeptide P37-42 (SEQ ID NOS:38-39) listed in Table E (Table E-1 to Table E-20), and including at least one or more of MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

In one embodiment there is provided a panel comprising one or more pools, or two or more pools, of MHC multimers, wherein each pool comprises one or more MHC multimers each comprising:

i) an antigenic peptide P derived from *Borrelia* antigenic polypeptide OppA (SEQ ID NOs:1-9) listed in Table A-1, Table A-2, Table A-3, Table A-4, Table A-5, Table A-6, Table A-7, Table A-8, Table A-9, Table A-10, Table A-11, Table A-12, Table A-13, Table A-14, Table A-15, table A-16, Table A-17, Table A-18, Table A-19, or Table A-20, ii) an antigenic peptide P derived from *Borrelia* antigenic polypeptide DbpA (SEQ ID NOs:10-20) listed in Table B-1, Table B-2, Table B-3, Table B-4, Table B-5, Table B-6, Table B-7, Table B-8, Table B-9, Table B-10, Table B-11, Table B-12, Table B-13, Table B-14, Table B-15, table B-16, Table B-17, Table B-18, or Table B-19, iii) an antigenic peptide P derived from *Borrelia* antigenic polypeptide FlhF (SEQ ID NOs:21-28) listed in Table C-1, Table C-2, Table C-3, Table C-4, Table C-5, Table C-6, Table C-7, Table C-8, Table C-9, Table C-10, Table C-11, Table C-12, Table C-13, Table C-14, Table C-15, table C-16, Table C-17, Table C-18, Table C-19, or Table C-20, iv) an antigenic peptide P derived from *Borrelia* antigenic polypeptide FlaB (SEQ ID NOs:29-37) listed in Table D-1, Table D-2, Table D-3, Table D-4, Table D-5, Table D-6, Table D-7, Table D-8, Table D-9, Table D-10, Table D-11, Table D-12, Table D-13, Table D-14, Table D-15, table D-16, Table D-17, Table D-18, Table D-19, or Table D-20, and/or v) an antigenic peptide P derived from *Borrelia* antigenic polypeptide P37-42 (SEQ ID NOS:38-39) listed in Table E-1, Table E-2, Table E-3, Table E-4, Table E-5, Table E-6, Table E-7, Table E-8, Table E-9, Table E-10, Table E-11, Table E-12, Table E-13, Table E-14, Table E-15, table E-16, Table E-17, Table E-18, Table E-19, or Table E-20.

In one embodiment there is provided a panel comprising two or more pools of MHC multimers, wherein one or more of said pools comprises one or more MHC multimers each MHC multimer comprising an antigenic peptide P selected from the group consisting of:

i) antigenic peptides P selected from the group consisting of YLNTKSNGNYEI (SEQ ID NO: 359), FLSIFTQGYT (SEQ ID NO: 241), GIYDLILNA (SEQ ID NO: 2761), and YIKDINEFI (SEQ ID NO: 4479), ii) antigenic peptides P selected from the group consisting of IQIEIEQLTDEI (SEQ ID NO: 5126), RMISDQRANLGA (SEQ ID NO: 5127) and SQGGVNSPV (SEQ ID NO: 5112), and/or iii) antigenic peptides P selected from the group consisting of IQIEIEQLTDEI (SEQ ID NO: 5126), MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

In one embodiment there is provided a panel comprising two or more pools of MHC multimers, wherein one or more of said pools comprises one or more MHC multimers each MHC multimer comprising antigenic peptides P selected from the group consisting of YLNTKSNGNYEI (SEQ ID NO: 359), FLSIFTQGYT (SEQ ID NO: 241), GIYDLILNA (SEQ ID NO: 2761), YIKDINEFI (SEQ ID NO: 4479), IQIEIEQLTDEI (SEQ ID NO: 5126), RMISDQRANLGA (SEQ ID NO: 5127), SQGGVNSPV (SEQ ID NO: 5112), MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

In one embodiment there is provided a panel comprising 3 or more pools of MHC multimers, wherein i) Pool 1 comprises one or more MHC multimers comprising YLNTKSNGNYEI (SEQ ID NO: 359), one or more MHC multimers comprising FLSIFTQGYT (SEQ ID NO: 241), one or more MHC multimers comprising GIYDLILNA (SEQ ID NO: 2761), and one or more MHC multimers comprising YIKDINEFI (SEQ ID NO: 4479), ii) Pool 2 comprises one or more MHC multimers comprising IQIEIEQLTDEI (SEQ ID NO: 5126), one or more MHC multimers comprising RMISDQRANLGA (SEQ ID NO: 5127) and one or more MHC multimers comprising SQGGVNSPV (SEQ ID NO: 5112), and iii) Pool 3 comprises one or more MHC multimers comprising MLDEAKDKL (SEQ ID NO: 5516), one or more MHC multimers comprising FMEQATNSWI (SEQ ID NO: 5530), one or more MHC multimers comprising NLVFSSLFL (SEQ ID NO: 5510) and one or more MHC multimers comprising KLAESIYKRL (SEQ ID NO: 5531);

iv) and optionally Pool 4 comprising one or more negative control MHC multimers, v) and optionally Pool 5 comprising one or more positive control MHC multimers.

In one embodiment there is provided a panel comprising 5 pools of MHC multimers, wherein i) Pool 1 comprises one or more MHC multimers comprising YLNTKSNGNYEI (SEQ ID NO: 359), one or more MHC multimers comprising FLSIFTQGYT (SEQ ID NO: 241), one or more MHC multimers comprising GIYDLILNA (SEQ ID NO: 2761), and one or more MHC multimers comprising YIKDINEFI (SEQ ID NO: 4479), ii) Pool 2 comprises one or more MHC multimers comprising IQIEIEQLTDEI (SEQ ID NO: 5126), one or more MHC multimers comprising RMISDQRANLGA (SEQ ID NO: 5127) and one or more MHC multimers comprising SQGGVNSPV (SEQ ID NO: 5112), iii) Pool 3 comprises one or more MHC multimers comprising MLDEAKDKL (SEQ ID NO: 5516), one or more MHC multimers comprising FMEQATNSWI (SEQ ID NO: 5530), one or more MHC multimers comprising NLVFSSLFL (SEQ ID NO: 5510) and one or more MHC multimers comprising KLAESIYKRL (SEQ ID NO: 5531), iv) Pool 4 comprises one or more MHC multimers comprising ALIAPVHAV (SEQ ID NO: 5913), and v) Pool 5 comprises one or more MHC multimers comprising NLVPMVATV (SEQ ID NO: 5914), one or more MHC multimers comprising GLCTLVAML (SEQ ID NO: 5915) and one or more MHC multimers comprising GILGFVFTL (SEQ ID NO: 5916).

Using the above described principles individual peptides or a subset of peptides able to bind one or more types of MHC molecules and make stable MHC-peptide complexes can be identified. The identified peptides can then be tested for biological relevance in functional assays such as interferon gamma release assays (e.g. ELISPOT), cytotoxicity assays (e.g. CTL killing assays) or using other methods as described elsewhere herein. Alternatively or complementary hereto the ability of the identified antigenic peptides to bind selected MHC molecules may be determined in binding assays like Biacore measurement, competition assays or other assays useful for measurement of binding of peptide to MHC molecules, known by skilled persons.

Borrelia* Sequences

In general, MHC Class I molecules will accommodate peptides of from about 8 amino acids in length to about 11-12 amino acids. Of special interest of the present disclosure are antigenic peptides, P, derived from *Borrelia* antigenic polypeptides selected from the group consisting of OppA, DbpA, FlhF, FlaB and P37-42. In the following *Borrelia* bacteria and their genes and proteins from which these *Borrelia* antigenic polypeptides may derive from are described in more detail.

*Borrelia* Bacteria

The various species of *Borrelia* are known to humans in the form of Lyme disease and recurring fever, transmitted through tick or flea bite. The cycle of *Borrelia* through animals is related to the tick's life cycle. The tick has four stages in its two-year life cycle, egg, larva, nymph and adult. Between each stage the tick needs a blood meal in order to mature. The tick usually acquires the spirochaete during its larval stage, when it feeds on small animals such as rodents or birds. Usually the tick picks up *Borrelia* from the white-footed mouse, which is commonly infected. The tick then becomes the host for the spirochaete. The bacteria resides in the digestive tract of the host for its next nymph and adult stages during which it is passed on to other animals, and sometimes humans.

*Borrelia* Species

*Borrelia* is a genus of bacteria of the spirochete class. It is a zoonotic, vector-borne disease transmitted primarily by ticks and some by lice, depending on the species. There are at least 50 known species of *Borrelia*. Different species of *Borrelia* results in different clinical symptoms. Of the 37 known species of *Borrelia,* 12 of these species are known to cause Lyme disease or borreliosis and are transmitted by ticks. The major *Borrelia* species causing Lyme disease are *Borrelia burgdorferi, Borrelia afzelii, Borrelia garinii* and *Borrelia valaisiana.*

In one embodiment of the present disclosure there is provided antigenic peptides, P, derived from *Borrelia* antigenic polypeptides selected from the group consisting of OppA, DbpA, FlhF, FlaB and P37-42, wherein said *Borrelia* antigenic polypeptides are derived from a *Borrelia* species selected from the group consisting of *Borrelia burgdorferi, Borrelia afzelii, Borrelia garinii* and *Borrelia valaisiana.*

In one embodiment of the present disclosure there is provided antigenic peptides, P, derived from *Borrelia burgdorferi* antigenic polypeptides selected from the group consisting of OppA, DbpA, FlhF, FlaB and P37-42.

In one embodiment of the present disclosure there is provided antigenic peptides, P, derived from *Borrelia afzelii* antigenic polypeptides selected from the group consisting of OppA, DbpA, FlhF, FlaB and P37-42.

In one embodiment of the present disclosure there is provided antigenic peptides, P, derived from *Borrelia garinii* antigenic polypeptides selected from the group consisting of OppA, DbpA, FlhF, FlaB and P37-42.

In one embodiment of the present disclosure there is provided antigenic peptides, P, derived from *Borrelia valaisiana* antigenic polypeptides selected from the group consisting of OppA, DbpA, FlhF, FlaB and P37-42.

Other *Borrelia* species cause relapsing fever such as *Borrelia recurrentis*, caused by the human body louse. No animal reservoir of *B. recurrentis* exists. Lice that feed on infected humans acquire the *Borrelia* organisms that then multiply in the gut of the louse. When an infected louse feeds on an uninfected human, the organism gains access when the victim crushes the louse or scratches the area where the louse is feeding. *B. recurrentis* infects the person via mucous membranes and then invades the bloodstream.

Other tick-borne relapsing infections are acquired from other species, such as *Borrelia hermsii* or *Borrelia Parkeri*, which can be spread from rodents, and serve as a reservoir for the infection, via a tick vector. *Borrelia hermsii* and *Borrelia recurrentis* cause very similar diseases although the disease associated with *Borrelia hermsii* has more relapses and is responsible for more fatalities, while the disease caused by *B. recurrentis* has longer febrile and afebrile intervals and a longer incubation period.

The present disclosure relates in one embodiment to one or more antigenic peptides P or to MHC-peptide complexes or MHC multimers comprising one or more antigenic peptides P comprising one or more sequences from one or more *Borrelia* species including the ones mentioned with the present disclosure; wherein said antigenic peptides P are derived from a *Borrelia* antigenic polypeptide selected from the group consisting of OppA, DbpA, FlhF, FlaB and P37-42.

*Borrelia burgdorferi*

In one preferred embodiment the disclosure relates to one or more antigenic peptides comprising one or more sequences from *Borrelia burgdorferi* such as *Borrelia burgdorferi* B31 or to one or more MHC-peptide complexes or MHC multimers comprising one or more such antigenic peptides.

*Borrelia burgdorferi* is species of bacteria of the spirochete class of the genus *Borrelia. B. burgdorferi* is predominant in North America, but also exists in Europe, and is the agent of Lyme disease.

It is a zoonotic, vector-borne disease transmitted by ticks and is named after the researcher Willy Burgdorfer who first isolated the bacterium in 1982. *B. burgdorferi* is one of the few pathogenic bacteria that can survive without iron, having replaced all of its iron-sulphur cluster enzymes with enzymes that use manganese, thus avoiding the problem many pathogenic bacteria face in acquiring iron. *B. burgdorferi* infections have been linked to non-Hodgkin lymphomas. The *B. burgdorferi* genome (B31 strain) contains 910,725 base pairs and 853 genes.

*Borrelia afzelii*

In one preferred embodiment the disclosure relates to one or more antigenic peptides comprising one or more sequences from *Borrelia afzelii* such as *Borrelia afzelii* Pko or one or more MHC-peptide complexes or one or more MHC multimers comprising one or more such antigenic peptides.

*Borrelia afzelii* is considered a separate species of the Genus *Borrelia* and considered homologous to *Borrelia burgdorferi* with regard to phenotypic, genetic, and immunological characteristics. Diseases linked to this species of *Borrelia* are Lyme disease and Acrodermatitis chronica atrophicans (ACA). Better understanding of the structure and function of this pathogen will create better methods of treatment to people with the diseases it causes.

*Borrelia garinii*

In one preferred embodiment the disclosure relates to one or more antigenic peptides comprising one or more sequences from *Borrelia garinii* such as *garinii* PBi or to one or more MHC-peptide complexes or MHC multimers comprising one or more such antigenic peptides.

*Borrelia garinii* is one of two major strains found in Europe. It usually causes Lyme Disease symptoms of the neurological kind—such as extreme back- and leg-pains, meningitis and partial facial paralysis, Lyme arthritis due to *B garinii* may be associated in susceptible hosts with amoxicillin resistance or treatment resistance.

Other *Borrelia* Species

In another embodiment the disclosure relates to one or more antigenic peptides or to one or more MHC-peptide complexes or MHC multimers comprising one or more such sequences or antigenic peptides, wherein said antigenic peptides are derived from a *Borrelia* species selected from the group consisting of *Borrelia anserina*, *Borrelia barbouri*, *Borrelia afzelii*, *Borrelia afzelii* ACA-1, *Borrelia afzelii* K78, *Borrelia afzelii* PKo, *Borrelia andersonii*, *Borrelia bissettii*, *Borrelia burgdorferi*, *Borrelia burgdorferi* 118a, *Borrelia burgdorferi* 156a, *Borrelia burgdorferi* 29805, *Borrelia burgdorferi* 64b, *Borrelia burgdorferi* 72a, *Borrelia burgdorferi* 80a, *Borrelia burgdorferi* 94a, *Borrelia burgdorferi* B31, *Borrelia burgdorferi* Bol26, *Borrelia burgdorferi* CA-11.2a, *Borrelia burgdorferi* W191-23, *Borrelia burgdorferi* ZS7, *Borrelia californiensis*, *Borrelia garinii*, *Borrelia garinii* PBi, *Borrelia garinii* PBr, *Borrelia genomosp. 1*, *Borrelia genomosp. 2*, *Borrelia japonica*, *Borrelia lusitaniae*, *Borrelia spielmanii*, *Borrelia spielmanii* A14S, *Borrelia tanukii*, *Borrelia turdi*, *Borrelia valaisiana*, *Borrelia valaisiana* VS116, Candidatus *Borrelia texasensis*, *Borrelia* sp. AA4Pool, *Borrelia* sp. AI-1, *Borrelia* sp. B31, *Borrelia* sp. BC-1, *Borrelia* sp. CA1133, *Borrelia* sp. CA1176, *Borrelia* sp. CA128, *Borrelia* sp. CA13, *Borrelia* sp. CA134, *Borrelia* sp. CA142, *Borrelia* sp. CA20, *Borrelia* sp. CA22, *Borrelia* sp. CA27, *Borrelia* sp. CA28, *Borrelia* sp. CA29, *Borrelia* sp. CA31, *Borrelia* sp. CA33, *Borrelia* sp. CA370, *Borrelia* sp. CA372, *Borrelia* sp. CA378, *Borrelia* sp. CA388, *Borrelia* sp. CA393, *Borrelia* sp. CA394, *Borrelia* sp. CA395, *Borrelia* sp. CA399, *Borrelia* sp. CA400, *Borrelia* sp. CA401, *Borrelia* sp. CA402, *Borrelia* sp. CA404, *Borrelia* sp. CA411, *Borrelia* sp. CA426, *Borrelia* sp. CA443, *Borrelia* sp. CA446, *Borrelia* sp. CA448, *Borrelia* sp. CA462, *Borrelia* sp. CA468, *Borrelia* sp. CA502, *Borrelia* sp. CA504, *Borrelia* sp. CA507, *Borrelia* sp. CA547, *Borrelia* sp. CA552, *Borrelia* sp. CA8, *Borrelia* sp. D22, *Borrelia* sp. D35, *Borrelia* sp. FD-1, *Borrelia* sp. FL18, *Borrelia* sp. FL27, *Borrelia* sp. FL35, *Borrelia* sp. FL42, *Borrelia* sp. HN6, *Borrelia* sp. HN7, *Borrelia* sp. HN8, *Borrelia* sp. HNM13, *Borrelia* sp. HNM14, *Borrelia* sp. HNM19, *Borrelia* sp. IA1, *Borrelia* sp. Ir-3519, *Borrelia* sp. Ir-4721, *Borrelia* sp. Ir-4812, *Borrelia* sp. Ir-5215, *Borrelia* sp. LV5, *Borrelia* sp. MI-2, *Borrelia* sp. MI-5, *Borrelia* sp. MI-6, *Borrelia* sp. MI-8, *Borrelia* sp. MI-9, *Borrelia* sp. MOD-1, *Borrelia* sp. MOD-5, *Borrelia* sp. MOK-3a, *Borrelia* sp. MOS-1b, *Borrelia* sp. NE49, *Borrelia* sp. NE581, *Borrelia* sp. PHaP, *Borrelia* sp. PSigII, *Borrelia* sp. SCGT-10, *Borrelia* sp. SCGT-8a, *Borrelia* sp. SCI-2, *Borrelia* sp. SCW-30h, *Borrelia* sp. SI-1, *Borrelia* sp. SI-10, *Borrelia* sp. SM-1, *Borrelia* sp. SV1, *Borrelia* sp. W97F51, *Borrelia* sp. Z41293, *Borrelia* sp. Z41493, *Borrelia coriaceae*, *Borrelia crocidurae*, *Borrelia duttonii*, *Borrelia duttonii* Ly, *Borrelia hermsii*, *Borrelia hermsii* DAH, *Borrelia hispanica*, *Borrelia lonestari*, *Borrelia miyamotoi*, *Borrelia parkeri*, *Borrelia persica*, *Borrelia recurrentis*, *Borrelia recurrentis* A1, *Borrelia sinica*, *Borrelia theileri*, *Borrelia turcica*, *Borrelia turicatae*, *Borrelia turicatae* 91E135, *Borrelia* sp., *Borrelia* sp. 'Lake Gaillard', *Borrelia* sp. 000133, *Borrelia* sp. 010298, *Borrelia* sp. 10MT, *Borrelia* sp. 5145, *Borrelia* sp. 57Nsk, *Borrelia* sp. 5MT, *Borrelia* sp. 6T04-2, *Borrelia* sp. BR, *Borrelia* sp. BR 2007, *Borrelia* sp. C5-N52, *Borrelia* sp. CB-A1, *Borrelia* sp. CB-A11, *Borrelia* sp. CB-A3, *Borrelia* sp. EFL-SO100110, *Borrelia* sp. IK/23, *Borrelia* sp. IM/16, *Borrelia* sp. IM/19, *Borrelia* sp. KR1, *Borrelia* sp. KR3, *Borrelia* sp. LB-2001, *Borrelia* sp. LB-M56, *Borrelia* sp. LB-W100, *Borrelia* sp. MK-N61, *Borrelia* sp. NR-N8, *Borrelia* sp. OkME1, *Borrelia* sp. PAnz, *Borrelia* sp. PJes, *Borrelia* sp. PMai, *Borrelia* sp. PMew, *Borrelia* sp. R57, *Borrelia* sp. strain Spain, *Borrelia* sp. TA1, *Borrelia* sp. TM, *Borrelia* sp. TM1 and/or *Borrelia* sp. TM2.

Gene Variants

The present disclosure further relates to one or more MHC-peptide complexes or MHC multimers, wherein the one or more *Borrelia* antigenic peptides are encoded by one or more gene variants. The present disclosure also relates to one or more antigenic *Borrelia* peptides that are encoded by one or more gene variants, such as a gene variant of a *Borrelia* antigenic polypeptide selected from the group consisting of OppA, DbpA, FlhF, FlaB and P37-42.

The term "variant gene" refers to nucleic acid molecules that encode a polypeptide having an amino acid sequence that is a modification of the polypeptides according to the present invention. Such variants include naturally-occurring polymorphisms of genes, as well as synthetic genes that contain conservative amino acid substitutions of the amino acid sequence of a polypeptide according to the present disclosure. Additional variant forms of genes are nucleic acid molecules that contain insertions or deletions of the nucleotide sequences described herein. A variant gene can be identified by determining whether the gene hybridizes with a nucleic acid molecule having the nucleotide sequence of an antigenic polypeptide according to the present disclosure, or its complement, under stringent conditions.

Variant Antigenic Peptides P

The present disclosure further relates to one or more *Borrelia* antigenic peptides as defined herein that have one or more modifications, such as one or more modifications compared to the one or more *Borrelia* antigenic peptides predicted from a *Borrelia* antigenic polypeptide selected from the group consisting of OppA, DbpA, FlhF, FlaB and P37-42 according to the present disclosure.

In one embodiment the antigenic peptide P according to the present disclosure comprises or consists of a modified sequence obtained by modification of an antigenic peptide P as defined herein above.

In one embodiment the antigenic peptide P comprises or consists of a modified sequence obtained by modification of a sequence selected from the sequences included in Tables A to E herein above (Tables A1-A20, B1-B19, C1-C20, D1-D20 and E1-E20).

In one embodiment said modified antigenic peptide P has at least 50%, such as at least 60%, such as at least 70%, such as at least 85%, such as at least 95% or such as at least 99% sequence identity with a sequence included in Tables A to E herein above (Tables A1-A20, B1-B19, C1-C20, D1-D20 and E1-E20).

Antigenic Peptides P with Amino Acid Substitutions

The present disclosure further relates to one or more *Borrelia* antigenic peptides P that have one or more amino acid substitutions, such as 1, 2, 3, 4, 5, 6, 7, or 8 amino acid substitutions, as well as MHC-peptide complexes or MHC multimers as disclosed herein comprising one or more *Borrelia* antigenic peptides having one or more amino acid substitutions such as such as 1, 2, 3, 4, 5, 6, 7, or 8 amino acid substitutions. The one or more *Borrelia* antigenic peptides are in one embodiment those predicted from a *Borrelia* antigenic polypeptide selected from the group consisting of OppA, DbpA, FlhF, FlaB and P37-42 according to the present disclosure.

In one embodiment the one or more amino acid substitutions are within the amino acid anchor motif. In another embodiment the one or more amino acid substitutions are outside the amino acid anchor motif. In one embodiment the one or more amino acid substitutions are within the 9-mer core motif. In another embodiment the one or more amino acid substitutions are outside the 9-mer core motif.

In one embodiment these amino acid substitutions comprise substitution with an "equivalent amino acid residue". An "equivalent amino acid residue" refers to an amino acid residue capable of replacing another amino acid residue in a polypeptide without substantially altering the structure and/or functionality of the polypeptide. Equivalent amino acids thus have similar properties such as bulkiness of the side-chain, side chain polarity (polar or non-polar), hydrophobicity (hydrophobic or hydrophilic), pH (acidic, neutral or basic) and side chain organization of carbon molecules (aromatic/aliphatic). As such, "equivalent amino acid residues" can be regarded as "conservative amino acid substitutions".

The classification of equivalent amino acids refers in one embodiment to the following classes: 1) HRK, 2) DENQ, 3) C, 4) STPAG, 5) MILV and 6) FYW.

Within the meaning of the term "equivalent amino acid substitution" as applied herein, one amino acid may be substituted for another, in one embodiment, within the groups of amino acids indicated herein below:

Amino acids having polar side chains (Asp, Glu, Lys, Arg, His, Asn, Gln, Ser, Thr, Tyr, and Cys,)

Amino acids having non-polar side chains (Gly, Ala, Val, Leu, Ile, Phe, Trp, Pro, and Met)

Amino acids having aliphatic side chains (Gly, Ala Val, Leu, Iie)

Amino acids having cyclic side chains (Phe, Tyr, Trp, His, Pro)

Amino acids having aromatic side chains (Phe, Tyr, Trp)

Amino acids having acidic side chains (Asp, Glu)

Amino acids having basic side chains (Lys, Arg, His)

Amino acids having amide side chains (Asn, Gln)

Amino acids having hydroxy side chains (Ser, Thr)

Amino acids having sulphor-containing side chains (Cys, Met),

Neutral, weakly hydrophobic amino acids (Pro, Ala, Gly, Ser, Thr)

Hydrophilic, acidic amino acids (Gln, Asn, Glu, Asp), and

Hydrophobic amino acids (Leu, Ile, Val)

A Venn diagram is another method for grouping of amino acids according to their properties (Livingstone & Barton, *CABIOS*, 9, 745-756, 1993). In another preferred embodiment one or more amino acids may be substituted with another within the same Venn diagram group.

In another embodiment these amino acid substitutions comprise substitution with a "non-equivalent amino acid residue". Non-equivalent amino acid residues are amino acid residues with dissimilar properties to the properties of the amino acid they substitute according to the groupings described above.

In one embodiment the modified antigenic peptide P comprises an anchor motif selected from the group of HLA motifs included in Table I herein above; such as comprises a primary anchoring amino acid residue in amino acid position 2 and/or 9 in accordance with Table I herein above.

In one embodiment the modified antigenic peptide P comprises a substitution of the amino acid residue in position 2 with an amino acid residue selected from the group consisting of:
  i) alanine, threonine, serine, valine, leucine, isoleucine, methionine, glutamine, phenylalanine, tryptophan and tyrosine,
  ii) alanine, threonine, serine, valine, leucine, isoleucine, methionine and glutamine
  iii) arginine, histidine and lysine,
  iv) aspartic acid and glutamic acid, or
  v) alanine, threonine and serine.

In one embodiment the antigenic peptide P or modified antigenic peptide P comprises a substitution of the amino acid residue in position 9 or 10 with an amino acid residue selected from the group consisting of:
  i) phenylalanine, tryptophan, tyrosine, leucine, isoleucine, valine, glutamine, alanine, argentine, histidine, lysine and methionine,
  ii) phenylalanine, tryptophan, tyrosine, leucine, isoleucine, valine, glutamine, alanine and methionine,
  iii) leucine, isoleucine, valine, glutamine, alanine and methionine,
  iv) phenylalanine, tryptophan, tyrosine, leucine, isoleucine and methionine
  v) glutamine and alanine, and
  vi) tyrosine, arginine and lysine.

In one embodiment the amino acid substitutions increases the affinity of the peptide for the MHC molecule and thereby increase the stability of the MHC-peptide complex.

In another embodiment the amino acid substitutions decreases the affinity of the peptide for the MHC molecule and thereby increase the stability of the MHC-peptide complex.

In one embodiment the amino acid substitutions increases the overall affinity of one or more T-cell receptors for the MHC-peptide complex containing the modified antigenic peptide.

In another embodiment the amino acid substitutions decreases the overall affinity of one or more T-cell receptors for the MHC-peptide complex containing the modified antigenic peptide.

Antigenic Peptides P Fragments

The present disclosure further relates to fragments of one or more *Borrelia* antigenic peptides as well as MHC monomers, MHC-peptide complexes or MHC multimers as disclosed herein comprising said antigenic peptide fragments, wherein said one or more *Borrelia* antigenic peptides are in one embodiment those predicted from a *Borrelia* antigenic polypeptide selected from the group consisting of OppA, DbpA, FlhF, FlaB and P37-42 according to the present disclosure.

The one or more antigenic peptides in one embodiment comprise or consist of a fragment of one or more antigenic peptides according to the present disclosure, such as a fragment consisting of 1, 2, 3, 4, 5, 6, 7, 8, 9, 10, 11 or 12 amino acids of said one or more antigenic peptide P, such as a fragment consisting of 1, 2, 3, 4, 5, 6, 7, 8, 9, 10, 11 or 12 amino acids of one or more antigenic peptides P included in Tables A to E herein above (Tables A1-A20, B1-B19, C1-C20, D1-D20 and E1-E20).

Other Peptide Modifications

In addition to the binding peptides designed by the total approach and/or directed approach, homologous peptides and peptides that have been modified in the amino acid side chains or in the backbone can be used as binding peptides.

In one embodiment the antigenic peptides according to the present disclosure are modified by one or more type(s) of post-translational modifications such as one or more of the post-translational modifications disclosed herein elsewhere. The same or different types of post-translational modification can occur on one or more amino acids in the antigenic peptide. Thus, in one embodiment, any one amino acid may be modified once, twice or three times with the same or different types of modifications. Furthermore, said identical and/or different modification may be present on 1, 2, 3, 4, 5, 6, 7, 8, 9, 10, 11 or 12 of the amino acid residues of the binding peptide according to the present disclosure.

Homologous Peptides

Homologues MHC peptide sequences may arise from the existence of multiple strongly homologous alleles, from small insertions, deletions, inversions or substitutions. If they are sufficiently homologous to peptides derived by the total approach, i.e. have an amino acid sequence identity greater than e.g. more than 90%, more than 80%, or more than 70%, or more than 60%, to one or two binding peptides derived by the total approach, they may be good candidates. Identity is often most important for the anchor residues.

A MHC binding peptide may be of split- or combinatorial epitope origin i.e. formed by linkage of peptide fragments derived from two different peptide fragments and/or proteins. Such peptides can be the result of either genetic recombination on the DNA level or due to peptide fragment association during the complex break down of proteins during protein turnover. Possibly it could also be the result of faulty reactions during protein synthesis i.e. caused by some kind of mixed RNA handling. A kind of combinatorial peptide epitope can also be seen if a portion of a longer peptide make a loop out leaving only the terminal parts of the peptide bound in the groove.

Uncommon, Artificial and Chemically Modified Amino Acids

Peptides having un-common amino acids, such as selenocysteine and pyrrolysine, may be bound in the MHC groove as well. Artificial amino acids e.g. having the isomeric D-form may also make up isomeric D-peptides that can bind in the binding groove of the MHC molecules. Bound peptides may also contain amino acids that are chemically modified or being linked to reactive groups that can be activated to induce changes in or disrupt the peptide. Example post-translational modifications are shown below. However, chemical modifications of amino acid side chains or the peptide backbone can also be performed.

Any of the modifications can be found individually or in combination at any position of the peptide, e.g. position 1, 2, 3, 4, 5, 6, etc. up to n.

TABLE

| | Post-translational modification of peptides Protein primary structure and posttranslational modifications |
|---|---|
| N-terminus | Acetylation, Formylation, Pyroglutamate, Methylation, Glycation, Myristoylation (Gly), carbamylation |
| C-terminus | Amidation, Glycosyl phosphatidylinositol (GPI), O-methylation, Glypiation, Ubiquitination, Sumoylation |
| Lysine | Methylation, Acetylation, Acylation, Hydroxylation, Ubiquitination, SUMOylation, Desmosine formation, ADP-ribosylation, Deamination and Oxidation to aldehyde |
| Cysteine | Disulfide bond, Prenylation, Palmitoylation |
| Serine/Threonine | Phosphorylation, Glycosylation |
| Tyrosine | Phosphorylation, Sulfation, Porphyrin ring linkage, Flavin linkage GFP prosthetic group (Thr-Tyr-Gly sequence) formation, Lysine tyrosine quinone (LTQ) formation, Topaquinone (TPQ) formation |
| Asparagine | Deamidation, Glycosylation |
| Aspartate | Succinimide formation |
| Glutamine | Transglutamination |
| Glutamate | Carboxylation, Methylation, Polyglutamylation, Polyglycylation |
| Arginine | Citrullination, Methylation |
| Proline | Hydroxylation |

Post Translationally Modified Peptides

The amino acids of the antigenic peptides, P, can also be modified in various ways dependent on the amino acid in question, or the modification can affect the amino- or carboxy-terminal end of the peptide (see table immediately herein above). Such peptide modifications occur naturally as the result of post-translational processing of the parental protein. A non-exhaustive description of the major post-translational modifications is given below, divided into three main types:

a) Modifications that Add a Chemical Moiety to the Binding Peptide, P:
   Acetylation, the addition of an acetyl group, usually at the N-terminus of the protein.
   Alkylation, the addition of an alkyl group (e.g. methyl, ethyl).
   Methylation, the addition of a methyl group, usually at lysine or arginine residues is a type of alkylation. Demethylation involves the removal of a methyl-group.
   Amidation at C-terminus.
   Biotinylation, acylation of conserved lysine residues with a biotin appendage formylation.

Gamma-carboxylation dependent on Vitamin K.
Glutamylation, covalent linkage of glutamic acid residues to tubulin and some other proteins by means of tubulin polyglutamylase.
Glycosylation, the addition of a glycosyl group to either asparagine, hydroxylysine, serine, or threonine, resulting in a glycoprotein. Distinct from glycation, which is regarded as a nonenzymatic attachment of sugars.
Glycylation, covalent linkage of one to more than 40 glycine residues to the tubulin C-terminal tail.
Heme moiety may be covalently attached.
Hydroxylation, is any chemical process that introduces one or more hydroxyl groups (—OH) into a compound (or radical) thereby oxidizing it. The principal residue to be hydroxylated is Proline. The hydroxilation occurs at the CY atom, forming hydroxyproline (Hyp). In some cases, proline may be hydroxylated instead on its CR atom. Lysine may also be hydroxylated on its C atom, forming hydroxylysine (Hyl). Iodination.
Isoprenylation, the addition of an isoprenoid group (e.g. farnesol and geranylgeraniol).
Lipoylation, attachment of a lipoate functionality, as in prenylation, GPI anchor formation, myristoylation, farnesylation, geranylation.
Nucleotides or derivatives thereof may be covalently attached, as in ADP-ribosylation and flavin attachment.
Oxidation, lysine can be oxidized to aldehyde.
Pegylation, addition of poly-ethylen-glycol groups to a protein. Typical reactive amino acids include lysine, cysteine, histidine, arginine, aspartic acid, glutamic acid, serine, threonine, tyrosine. The N-terminal amino group and the C-terminal carboxylic acid can also be used
Phosphatidylinositol may be covalently attached.
Phosphopantetheinylation, the addition of a 4'-phosphopantetheinyl moiety from coenzyme A, as in fatty acid, polyketide, non-ribosomal peptide and leucine biosynthesis.
Phosphorylation, the addition of a phosphate group, usually to serine, tyrosine, threonine or histidine.
Pyroglutamate formation as a result of N-terminal glutamine self-attack, resulting in formation of a cyclic pyroglutamate group.
Racemization of proline by prolyl isomerase.
tRNA-mediated addition of amino acids such as arginylation.
Sulfation, the addition of a sulfate group to a tyrosine.
Selenoylation (co-translational incorporation of selenium in selenoproteins).
b) Modification that Adds Protein or Peptide:
ISGylation, the covalent linkage to the ISG15 protein (Interferon-Stimulated Gene 15).
SUMOylation, the covalent linkage to the SUMO protein (Small Ubiquitin-related MOdifier).
Ubiquitination, the covalent linkage to the protein ubiquitin.
c) Modification that Converts One or More Amino Acids to Different Amino Acids:
Citrullination, or deimination the conversion of arginine to citrulline. Deamidation, the conversion of glutamine to glutamic acid or asparagine to aspartic acid.
The peptide modifications can occur as modification of a single amino acid or more than one i.e. alone or in combinations. Modifications can be present on any position within the peptide i.e. on position 1, 2, 3, 4, 5, etc. for the entire length of the peptide P.

Sources of Binding Peptides a) From Natural Sources

The binding peptides can be obtained from natural sources by enzymatic digestion or proteolysis of natural proteins or proteins derived by in vitro translation of mRNA. Binding peptides may also be eluted from the MHC binding groove.

b) From Recombinant Sources

1) As Monomeric or Multimeric Peptide

Alternatively peptides can be produced recombinantly by transfected cells either as monomeric antigenic peptides or as multimeric (concatemeric) antigenic peptides. Optionally, the Multimeric antigenic peptides are cleaved to form monomeric antigenic peptides before binding to MHC protein.

2) As Part of a Bigger Recombinant Protein

Binding peptides may also constitute a part of a bigger recombinant protein e.g. consisting of;

2a) for MHC Class 1 Binding Peptides;

Peptide-linker-β2m, β2m being full length or truncated;

Peptide-linker-MHC class 1 heavy chain, the heavy chain being full length or truncated. Most importantly the truncated class I heavy chain will consist of the extracellular part i.e the α1, □α2, and α domains. The heavy chain fragment may also only contain the α1 and α2 domains, or α1 domain alone, or any fragment or full length β2m or heavy chain attached to a designer domain(s) or protein fragment(s).

c) From Chemical Synthesis

MHC binding peptide may also be chemically synthesized by solid phase or fluid phase synthesis, according to standard protocols.

Comprehensive collections of antigenic peptides, derived from one antigen, may be prepared by a modification of the solid phase synthesis protocol, as described in the following and exemplified in Example 24.

The protocol for the synthesis of the full-length antigen on solid support is modified by adding a partial cleavage step after each coupling of an amino acid. Thus, the starting point for the synthesis is a solid support to which has been attached a cleavable linker. Then the first amino acid X1 (corresponding to the C-terminal end of the antigen) is added and a coupling reaction performed. The solid support now carries the molecule "linker-X1". After washing, a fraction (e.g. 10%) of the cleavable linkers are now cleaved, to release into solution X1. The supernatant is transferred to a collection container. Additional solid support carrying a cleavable linker is added, e.g. corresponding to 10% of the initial amount of solid support.

Then the second amino acid X2 is added and coupled to X1 or the cleavable linker, to form on solid support the molecules "linker-X2" and "linker-X1-X2". After washing, a fraction (e.g. 10%) of the cleavable linker is cleaved, to release into solution X2 and X1-X2. The supernatant is collected into the collection container, which therefore now contains X1, X2, and X1-X2. Additional solid support carrying a cleavable linker is added, e.g. corresponding to 10% of the initial amount of solid support.

Then the third amino acid X3 is added and coupled to X2 or the cleavable linker, to form on solid support the molecules "linker-X3", "linker-X2-X3" and "linker-X1-X2-X3". After washing, a fraction (e.g. 10%) of the cleavable linker is cleaved, to release into solution X3, X2-X3 and X1-X2-X3. The supernatant is collected into the collection container, which therefore now contains X1, X2, X3, X1-X2, X2-X3 and X1-X2-X3. Additional solid support carrying a cleavable linker is added, e.g. corresponding to 10% of the initial amount of solid support.

This step-wise coupling and partial cleavage of the linker is continued until the N-terminal end of the antigen is reached. The collection container will now contain a large number of peptides of different length and sequence. In the present example where a 10% partial cleavage was employed, a large fraction of the peptides will be 8'-mers, 9'-mers, 10'-mers and 11'-mers, corresponding to class I antigenic peptides. As an example, for a 100 amino acid antigen the 8'-mers will consist of the sequences X1-X2-X3-X4-X5-X6-X7-X8, X2-X3-X4-X5-X6-X7-X8-X9, . . . , X93-X94-X95-X96-X97-X98-X99-X100.

Optionally, after a number of coupling and cleavage steps or after each coupling and cleavage step, the used (inactivated) linkers on solid support can be regenerated, in order to maintain a high fraction of linkers available for synthesis. The collection of antigenic peptides can be used as a pool for e.g. the display by APCs to stimulate CTLs in ELISPOT assays, or the antigenic peptides may be mixed with one or more MHC alleles, to form a large number of different MHC-peptide complexes which can e.g. be used to form a large number of different MHC multimers which can e.g. be used in flow cytometry experiments.

Choice of MHC Allele for Generation of MHC Monomers and MHC Multimers

More than 600 MHC alleles (class 1 and 2) are known in humans; for many of these, the peptide binding characteristics are known. FIG. 3 of WO 2009/106073 presents a list of the HLA class 1 alleles. The frequency of the different HLA alleles varies considerably, also between different ethnic groups—as illustrated for top 30 HLA class I alleles (See eg. FIG. 4 in WO 2009/106073). Thus it is of outmost importance to carefully select the MHC alleles that corresponds to the population that one wish to study.

In one embodiment the MHC protein of the present disclosure is selected from the group of HLA alleles consisting of: A*0201, C*0701, A*0101, A*0301, C*0702, C*0401, B*4402, B*0702, B*0801, C*0501, C*0304, C*0602, A*1101, B*4001, A*2402, B*3501, C*0303, B*5101, C*1203, B*1501, A*2902, A*2601, A*3201, C*0802, A*2501, B*5701, B*1402, C*0202, B*1801, B*4403, C*0401, C*0701, C*0602, A*0201, A*2301, C*0202, A*0301, C*0702, B*5301, B*0702, C*1601, B*1503, B*5801, A*6802, C*1701, B*4501, B*4201, A*3001, B*3501, A*0101, C*0304, A*3002, B*0801, A*3402, A*7401, A*3303, C*1801, A*2902, B*4403, B*4901, A*0201, C*0401, A*2402, C*0702, C*0701, C*0304, A*0301, B*0702, B*3501, C*0602, C*0501, A*0101, A*1101, B*5101, C*1601, B*4403, C*0102, A*2902, C*0802, B*1801, A*3101, B*5201, B*1402, C*0202, C*1203, A*2601, A*6801, B*0801, A*3002, B*4402, A*1101, A*2402, C*0702, C*0102, A*3303, C*0801, C*0304, A*0201, B*4001, C*0401, B*5801, B*4601, B*5101, C*0302, B*3802, A*0207, B*1501, A*0206, C*0303, B*1502, A*0203, B*4403, C*1402, B*3501, C*0602, B*5401, B*1301, B*4002, B*5502 and A*2601.

In one embodiment the MHC protein of the present disclosure is selected from the group of HLA alleles consisting of: HLA-A*A0101, A0201, A0301, A1101, A2402, A2501, A2601, A2902, A3101, A3201, A6801, B0702, B0801, B1503, B1801, B3501, B4002, B4402, B4501 and B5101.

The Combined Choice of Peptide, MHC and Carrier

Herein above it has been described how to generate binding peptides, and which MHC alleles are available. Herein below it is further described how one may modify the binding peptides in order to increase the stability, affinity, specificity and other features of the MHC-peptide complex or the MHC multimer. In the following it is described what characteristics of binding peptides and MHC alleles are important when using the MHC-peptide complex or MHC-multimer for various different purposes.

A first preferred embodiment employs binding peptides of particularly high affinity for the MHC proteins. This may be done in order to increase the stability of the MHC-peptide complex. A higher affinity of the binding peptide for the MHC proteins may in some instances also result in increased rigidity of the MHC-peptide complex, which in turn often will result in higher affinity and/or specificity of the MHC-peptide complex for the T-cell receptor. A higher affinity and specificity will in turn have consequences for the immunogenicity and allergenicity, as well as possible side-effects of the MHC-peptide complex in e.g. the body.

Binding peptides of particularly high affinity for the MHC proteins may be identified by several means, including the following Incubation of candidate binding peptides and MHC proteins, followed by analysis of the resulting complexes to identify those binding peptides that have most frequently been associated with MHC proteins. The binding peptides that have most frequently been associated with MHC proteins typically will represent high-affinity binding peptides. The identification of binding peptides with particularly high-affinity may involve enrichment of binding peptides, e.g. incubation of candidate peptides with immobilized MHC molecules, removal of non-binding peptides by e.g. washing, elution of binding peptides. This pool of peptides enriched for binding to the chosen MHC molecules may then be identified e.g. by mass spectrometry or HPLC and amino acid sequencing or the pool can be further enriched by another round of incubation with immobilized MHC.

Candidate binding peptides may be compared to consensus sequences for the binding to a specific MHC allele. Thus, for a given class 1 allele, the consensus 8'mer sequence may be given by the sequence "X1-X2-X3-X4-X5-X6-X7-X8", where each of the X1-X8 amino acids can be chosen from a specific subset of amino acids, as described above. Those binding peptides that correlate the best with the consensus sequence are expected to have particularly high affinity for the MHC allele in question.

Based on a large data set of affinities of binding peptides for specific MHC alleles, software programs (often involving neural networks) have been developed that allow a relatively accurate prediction of the affinity of a given candidate binding peptide for a given MHC allele. By examining candidate binding peptides using such software programs, one can identify binding peptides of expected high-affinity for the MHC molecule.

A second preferred embodiment employs binding peptides with medium affinity for the MHC molecule. A medium affinity of the peptide for the MHC protein will often lead to lower physical and chemical stability of the MHC-peptide complex, which can be an advantage for certain applications. As an example, it is often desirable to administer a drug on a daily basis due to convenience. An MHC-peptide complex-based drug with high stability in the body would not allow this. In contrast a binding peptide with medium or low affinity for the MHC protein can be an advantage for such applications, since these functional MHC-peptide molecules will be cleared more rapidly from the body due to their lower stability.

For some applications where some level of cross-talk is desired, e.g. in applications where the target is a number of T cell clones that interact with a number of structurally related MHC-peptide complexes, e.g. MHC-peptide complexes containing binding peptides from different strains of a given species, a medium or low affinity of the binding peptide for the MHC protein can be an advantage. Thus, these MHC-peptide complexes are often more structurally flexible, allowing the MHC-peptide complexes to interact with several structurally related TCRs.

The affinity of a given peptide for a MHC protein, predicted by a software program or by its similarity to a consensus sequence, should only be considered a guideline to its real affinity. Moreover, the affinity can vary a lot depending on the conditions in the environment, e.g. the affinity in blood may be very different from the affinity in a biochemical assay. Further, in the context of a MHC multimer, the flexibility of the MHC-peptide complex can sometimes be an important parameter for overall avidity.

In summary, a lot of factors must be considered for the choice of binding peptides in a certain application. Some applications benefit from the use of all possible binding peptides for an antigen ("total approach"), other applications benefit from the selective choice of just a few binding peptides. Depending on the application, the affinity of the binding peptide for MHC protein is preferably high, medium, or low; the physical and/or chemical stability of the MHC-peptide complex is preferably high, medium or low; the binding peptide is preferably a very common or very rare epitope in a given population; etc.

It is obvious from the above preferred embodiments that most or all of the binding peptides generated by the total approach have important applications. In other words, in order to make relevant MHC multimers that suit the different applications with regard to e.g. personalized or general targeting, or with regard to affinity, avidity, specificity, immunogenicity, stimulatory efficiency, or stability, one must be able to choose from the whole set of binding peptides generated by the total approach.

Loading of the Peptide into the MHC Multimer

Loading of the peptides into the MHCmer MHC class 1 can be performed in a number of ways depending on the source of the peptide and the MHC, and depending on the application.

The antigenic peptide may be added to the other peptide chain(s) at different times and in different forms, as follows
a) Loading of antigenic peptide during MHC complex folding:
  a. Antigenic peptide is added as a free peptide MHC class I molecules are most often loaded with peptide during assembly in vitro by the individual components in a folding reaction i.e. consisting of purified recombinant heavy chain a with the purified recombinant P2 microglobulin and a peptide or a peptide mix.
  b. Antigenic peptide is part of a recombinant protein construct Alternatively the peptide to be folded into the binding groove can be encoded together with e.g. the a heavy chain or fragment hereof by a gene construct having the structure, heavy chain-flexible linker-peptide. This recombinant molecule is then folded in vitro with P2-microglobulin.
b) Antigenic peptide replaces another antigenic peptide by an exchange reaction:
  a. Exchange reaction "in solution"
    Loading of desired peptide can also be made by an in vitro exchange reaction where a peptide already in place in the binding groove are being exchanged by another peptide species.
  b. Exchange reaction "in situ"
    Peptide exchange reactions can also take place when the parent molecule is attached to other molecules, structures, surfaces, artificial or natural membranes and nano-particles.
  c. Aided exchange reaction.
    This method can be refined by making the parent construct with a peptide containing a meta-stable amino acid analogue that is split by either light or chemically induction thereby leaving the parent structure free for access of the desired peptide in the binding groove.
  d. Display by in vivo loading
    Loading of MHC class I molecules expressed on the cell surface with the desired peptides can be performed by an exchange reaction. Alternatively cells can be transfected by the peptides themselves or by the mother proteins that are then being processed leading to an in vivo analogous situation where the peptides are bound in the groove during the natural cause of MHC expression by the transfected cells. In the case of professional antigen presenting cells e.g. dendritic cells, macrophages, Langerhans cells, the proteins and peptides can be taken up by the cells themselves by phagocytosis and then bound to the MHC complexes the natural way and expressed on the cell surface in the correct MHC context.

Other Features of Product

In one preferred embodiment the MHC multimer is between 50,000 Da and 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000 Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 980,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.

In another embodiment the MHC multimer is between 1,000,000 Da and 3,000,000 Da, such as from 1,000,000 Da to 2,800,000; for example from 1,000,000 Da to 2,600,000; such as from 1,000,000 Da to 2,400,000; for example from 1,000,000 Da to 2,200,000; such as from 1,000,000 Da to 2,000,000; for example from 1,000,000 Da to 1,800,000; such as from 1,000,000 Da to 1,600,000; for example from 1,000,000 Da to 1,400,000.

Above it was described how to design and produce the key components of the MHC multimers, i.e. the MHC-peptide complex. In the following it is described how to generate the MHC monomer or MHC multimer products of the present disclosure.

Number of MHC Complexes Per Multimer

A non-exhaustive list of possible MHC mono- and multimers illustrates the possibilities. 'n' indicates the number of MHC complexes comprised in the multimer of the present disclosure:

a) n=1, Monomers
b) n=2, Dimers, multimerization can for example be based on IgG scaffold, streptavidin with two MHC's, coiled-coil dimerization e.g. Fos.Jun dimerization
c) n=3, Trimers, multimerization can for example be based on streptavidin as scaffold with three MHC's, TNFalpha-MHC hybrids, triplex DNA-MHC conjugates or other trimer structures
d) n=4, Tetramers, multimerization can for example be based on streptavidin with all four binding sites occupied by MHC molecules or based on dimeric IgA
e) n=5, Pentamers, multimerization for example can take place around a pentameric coil-coil structure
f) n=6, Hexamers
g) n=7, Heptamers
h) n=8-12, Octa-dodecamers, multimerization can for example use Streptactin
i) n=10, Decamers, multimerization can for example use IgM
j) 1<n<100, Dextramers, as multimerization domain polymers such as polypeptides, polysaccharides and Dextrans can for example be used.
k) 1<n<1000, Multimerization can for example make use of dendritic cells (DC), antigen-presenting cells (APC), micelles, liposomes, beads, surfaces e.g. microtiter-plate, tubes, microarray devices, micro-fluidic systems
l) 1<n, n in billions or trillions or higher, multimerization can for example take place on beads, and surfaces e.g. microtiterplate, tubes, microarray devices, micro-fluidic systems In one embodiment the panel of the present disclosure comprises MHC multimers $(a-b-P)_n$, wherein n>1, comprising two or more MHC proteins each in complex with an antigenic peptide P to form an MHC-peptide complex. In a preferred embodiment the MHC proteins are class I MHC proteins.

In one embodiment the panel of the present disclosure comprises MHC multimers $(a-b-P)_n$, wherein the value of n is selected from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 50, 55, 60, 65, 70, 75, 80, 85, 90, 95, 100, 110, 120, 130, 140, 150, 160, 170, 180, 190, 200, 250, 300, 350, 400, 450, 500, 550, 600, 650, 700, 750, 800, 850, 900, 950 and 1000.

In one embodiment the panel of the present disclosure comprises MHC multimers $(a-b-P)_n$, wherein the value of n is 1<n≥1000, such as between 2-3, 3-4, 4-5, 5-6, 6-7, 7-8, 8-9, 9-10, 10-11, 11-12, 12-13, 13-14, 14-15, 15-16, 16-17, 17-18, 18-19, 19-20, 20-21, 21-22, 22-23, 23-24, 24-25, 25-26, 26-27, 27-28, 28-29, 29-30, 30-35, 35-40, 40-45, 45-50, 50-55, 55-60, 60-65, 65-70, 75-80, 80-85, 85-90, 90-95, 95-100, 100-110, 110-120, 120-130, 130-140, 140-150, 150-160, 160-170, 170-180, 180-190, 190-200, 200-225, 225-250, 250-275, 275-300, 300-325, 325-350, 350-

375, 375-400, 400-450, 450-500, 500-550, 550-600, 600-650, 650-700, 700-750, 750-800, 800-850, 850-900, 900-950, 950-1000.

In one embodiment the panel of the present disclosure comprises MHC multimers (a-b-P)$_n$, wherein the value of n is >1, such as 2, such as >2, such as ≥2, such as 3, such as >3, such as ≥3, such as 4, such as >4, such as ≥4, such as 5, such as >5, such as ≥5, such as 6, such as >6, such as ≥6, such as 7, such as >7, such as ≥7, such as 8, such as >8, such as ≥8, such as 9, such as >9, such as ≥9, such as 10, such as >10, such as ≥10.

MHC multimers thus include MHC-dimers, MHC-trimers, MHC-tetramers, MHC-pentamers, MHC-hexamers, and MHC n-mers, as well as organic molecules, cells, membranes, polymers and particles that comprise two or more MHC-peptide complexes. Example organic molecule-based multimers include functionalized cyclic structures such as benzene rings where e.g. a benzene ring is functionalized and covalently linked to e.g. three MHC complexes; example cell-based MHC multimers include dendritic cells and antigen presenting cells (APCs); example membrane-based MHC multimers include liposomes and micelles carrying MHC-peptide complexes in their membranes; example polymer-based MHC multimers include MHC-dextramers (dextran to which a number of MHC-peptide complexes are covalently or non-covalently attached) and example particles include beads or other solid supports with MHC complexes immobilized on the surface. Obviously, any kind of multimerization domain can be used, including any kind of cell, polymer, protein or other molecular structure, or particles and solid supports.

Any of the three components of a MHC complex can be of any of the below mentioned origins. The list is non-exhaustive. A complete list would encompass all Chordate species. By origin is meant that the sequence is identical or highly homologous to a naturally occurring sequence of the specific species.

List of origins: Human, Mouse, Primate (including Chimpansee, Gorilla, Orang Utan), Monkey (including Macaques), Porcine (Swine/Pig), Bovine (Cattle/Antilopes), Equine (Horse), Camelides (Camels), Ruminants (Deer), Canine (Dog), Feline (Cat), Bird (including Chicken, Turkey), Fish, Reptiles and Amphibians.

In one embodiment the MHC of the present disclosure is a MHC class I complex of HLA-type A. In one embodiment the MHC is a MHC class I complex of HLA-type B. In one embodiment the MHC is a MHC class I complex of HLA-type C.

In one embodiment the MHC of the present disclosure is a MHC class I complex
  of supertype HLA-A1 (eg. HLA-A*0101, HLA-A*2601, HLA-A*2602, HLA-A2603, HLA-A*3002, HLA-A*3003, HLA-A*3004, HLA-A*3201),
  of supertype HLA-A01 A03 (eg. HLA-A*3001),
  of supertype HLA-A01 A024 (eg. HLA-A*2902),
  of supertype HLA-A2 (eg. HLA-A*0201, HLA-A*0202, HLA-A*0203, HLA-A*0204, HLA-A*0205, HLA-A*0206, HLA-A*0207, HLA-A*0214, HLA-A*0217, HLA-A*6802, HLA-A*6901),
  of supertype HLA-A3 (eg. HLA-A*0301, HLA-A*1101, HLA-A*3101, HLA-A*3301, HLA-A*3303, HLA-A*6601, HLA-A*6801, HLA-A*7401),
  of supertype HLA-A24 (eg. HLA-A*2301, HLA-A*2402),
  of supertype HLA-B7 (eg. HLA-B*0702, HLA-B*0703, HLA-B*0705, HLA B*1508, HLA-B*3501, HLA-B*3503, HLA-B*4201, HLA-B*5101, HLA-B*5102, HLA-B*5103, HLA-B*5301, HLA-B*5401, HLA-B*5501, HLA-B*5502, HLA-B*5601, HLA-B*6701, HLA-B*7801),
  of supertype HLA-B8 (eg. HLA-B*0801, HLA-B*0802),
  of supertype HLA-B27 (eg. HLA-B*1402, HLA-B*1503, HLA-B*1509, HLA-B*1510, HLA-B*1518, HLA-B*2702, HLA-B*2703, HLA-B*2704, HLA-B*2705, HLA-B*2706, HLA-B*2707, HLA-B*2708, HLA-B*2709, HLA-B*3801, HLA-B*3901, HLA-B*3902, HLA-B*3909, HLA-B*4801, HLA-B*7301),
  of supertype HLA-B44 (eg. HLA-B*1801, HLA-B*3701, HLA-B*4001, HLA-B*4002, HLA-B*4006, HLA-B*4402, HLA-B*4403, HLA-B*4501),
  of supertype HLA-B58 (eg. HLA-B*1516, HLA-B*1517, HLA-B*5701, HLA-B*5702, HLA-B*5801, HLA-B*5802),
  of supertype HLA-B62 (eg. HLA-B*1501, HLA-B*1502, HLA-B*1512, HLA-B*1513, HLA-B*4601, HLA-B*5201), and/or
  of supertype HLA Cw 1-8 (eg. HLA-C*01, HLA-C*02, HLA-C*03, HLA-C*04, HLA-C*05, HLA-C*06, HLA-C*07, HLA-C*08).

In one embodiment the MHC of the present disclosure is a MHC class I complex, which binds peptides
  with an acidic amino acid on $3^{rd}$ position (eg. HLA-A*0101, HLA-A*2601, HLA-A*2602, HLA-A*2603, HLA-A*3002, HLA-A*3003, HLA-A*3004, HLA-A*3201),
  with a hydrophobic amino acid on $9^{th}$ position (eg. HLA-A*0201 . . . 0207, A*0214, A*0217, A*6802, A*6901, HLA-B*1516, B*1517, B*5701, B*5702, B*5801, B*5802),
  with a Basic amino acid on $9^{th}$ position (eg. HLA-A*0301, HLA-A*1101, HLA-A*3101, HLA-A*3301, HLA-A*3303, HLA-A*6601, HLA-A*6801, HLA-A*7401),
  with a Tyrosine amino acid on $2^{nd}$ position (eg. HLA-A*2301, HLA-A*2402),
  with a Proline amino acid on $2^{nd}$ position (eg. HLA-B*0702, HLA-B*0703, HLA-B*0705, HLA-B*1508, HLA-B*3501, HLA-B*3503, HLA-B*4201, HLA-B*5101, HLA-B*5102, HLA-B*5103, HLA-B*5301, HLA-B*5401, HLA-B*5501, HLA-B*5502, HLA-B*5601, HLA-B*6701, HLA-B*7801),
  with a Lysine amino acid on $3^{rd}$ and $5^{th}$ position (eg. HLA-B*0801, B*0802),
  with a Arginine amino acid on $2^{nd}$ position (eg. HLA-B*1402, HLA-B*1503, HLA-B*1509, HLA-B*1510, HLA-B*1518, HLA-B*2702, HLA-B*2703, HLA-B*2704, HLA-B*2705, HLA-B*2706, HLA-B*2707, HLA-B*2708, HLA-B*2709, HLA-B*3801, HLA-B*3901, HLA-B*3902, HLA-B*3909, HLA-B*4801, HLA-B*7301), and/or
  with a Glutamic acid amino acid on $2^{nd}$ position (eg. HLA-B*1801, HLA-B*3701, HLA-B*4001, HLA-B*4002, HLA-B*4006, HLA-B*4402, HLA-B*4403, HLA-B*4501),
  with a Tyrosine amino acid on $9^{th}$ position (eg. HLA-B*1501, HLA-B*1502, HLA-B*1512, HLA-B*1513, HLA-B*4601, HLA-B*5201).

In one embodiment the MHC of the present disclosure is a MHC class I complex, which in the B pocket selectively binds small or aliphatic peptides (e.g. HLA-A*0101, HLA-A*2601, HLA-A*2602, HLA-A*2603, HLA-A*3002, HLA-A*3003, HLA-A*3004, HLA-A*3201, A*0201, HLA-A*0202, HLA-A*0203, HLA-A*0204, HLA-A*0205, HLA-A*0206, HLA-A*0207, HLA- A*0214, HLA-A*0217, HLA-A*6802, HLA-A*6901, HLA-A*0301, HLA-A*1101, HLA-A*3101, HLA-A*3301, HLA-A*3303, HLA-A*6601, HLA-A*6801, HLA-A*7401).

In one embodiment the MHC of the present disclosure is a MHC class I complex, which in the F pocket selectively binds aliphatic peptides (e.g. HLA-A*0101, HLA-A*2601 ... 2603, HLA-A*3002, HLA-A*3003, HLA-A*3004, HLA-A*3201, HLA-A*0201, HLA-A*0202, HLA-A*0203, HLA-A*0204, HLA-A*0205, HLA-A*0206, HLA-A*0207, HLA-A*0214, HLA-A*0217, HLA-A*6802, HLA-A*6901, HLA-A*0301, HLA-A*1101, HLA-A*3101, HLA-A*3301, HLA-A*3303, HLA-A*6601, HLA-A*6801, HLA-A*7401, HLA-B*1501, HLA-B*1502, HLA-B*1512, HLA-B*1513, HLA-B*4601, HLA-B*5201).

Generation of MHC Multimers

Different approaches to the generation of various types of MHC multimers are described in U.S. Pat. No. 5,635,363 (Altman et al.), patent application WO 02/072631 A2 (Winther et al.), patent application WO 99/42597, US patent 2004209295, U.S. Pat. No. 5,635,363, and is described elsewhere in the present disclosure as well. In brief, MHC multimers can be generated by first expressing and purifying the individual protein components of the MHC protein, and then combining the MHC protein components and the peptide, to form the MHC-peptide complex. Then an appropriate number of MHC-peptide complexes are linked together by covalent or non-covalent bonds to a multimerization domain. This can be done by chemical reactions between reactive groups of the multimerization domain (e.g. vinyl sulfone functionalities on a dextran polymer) and reactive groups on the MHC protein (e.g. amino groups on the protein surface), or by non-covalent interaction between a part of the MHC protein (e.g. a biotinylated peptide component) and the multimerization domain (e.g. four binding sites for biotin on the strepavidin tetrameric protein). As an alternative, the MHC multimer can be formed by the non-covalent association of amino acid helices fused to one component of the MHC protein, to form a pentameric MHC multimer, held together by five helices in a coiled-coil structure making up the multimerization domain.

Appropriate chemical reactions for the covalent coupling of MHC and the multimerization domain include nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions.

Appropriate molecules, capable of providing non-covalent interactions between the multimerization domain and the MHC-peptide complex, involve the following molecule pairs and molecules: streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. In particular, when the MHC complex is tagged, the binding entity can be an "anti-tag". By "anti-tag" is meant an antibody binding to the tag and any other molecule capable of binding to such tag.

Generation of Components of MHC

When employing MHC multimers for diagnostic purposes, it is preferable to use a MHC allele that corresponds to the tissue type of the person or animal to be diagnosed. Once the MHC allele has been chosen, a peptide derived from the antigenic protein may be chosen. The choice will depend on factors such as known or expected binding affinity of the MHC protein and the various possible peptide fragments that may be derived from the full sequence of the antigenic peptide, and will depend on the expected or known binding affinity and specificity of the MHC-peptide complex for the TCR. Preferably, the affinity of the peptide for the MHC molecule, and the affinity and specificity of the MHC-peptide complex for the TCR, should be high.

Similar considerations apply to the choice of MHC allele and peptide for therapeutic and vaccine purposes. In addition, for some of these applications the effect of binding the MHC multimer to the TCR is also important. Thus, in these cases the effect on the T-cell's general state must be considered, e.g. it must be decided whether the desired end result is apoptosis or proliferation of the T-cell.

Likewise, it must be decided whether stability is important. For some applications low stability may be an advantage, e.g. when a short-term effect is desired; in other instances, a long-term effect is desired and MHC multimers of high stability is desired. Stabilities of the MHC protein and of the MHC-peptide complex may be modified as described elsewhere herein.

Finally, modifications to the protein structure may be advantageous for some diagnostics purposes, because of e.g. increased stability, while in for vaccine purposes modifications to the MHC protein structure may induce undesired allergenic responses.

Generation of Protein Chains of MHC

Generation of MHC Class/Heavy Chain and β2-Microglobulin

MHC class I heavy chain (HC) and β2-microglobulin (β2m) can be obtained from a variety of sources.
  a) Natural sources by means of purification from eukaryotic cells naturally expressing the MHC class 1 or β2m molecules in question.
  b) The molecules can be obtained by recombinant means e.g. using.
    a. in vitro translation of mRNA obtained from cells naturally expressing the MHC or β2m molecules in question
    b. by expression and purification of HC and/or β2m gene transfected cells of mammalian, yeast, bacterial or other origin. This last method will normally be the method of choice. The genetic material used for transfection/transformation can be:

i. of natural origin isolated from cells, tissue or organisms
ii. of synthetic origin i.e. synthetic genes identical to the natural DNA sequence or it could be modified to introduce molecular changes or to ease recombinant expression.

The genetic material can encode all or only a fragment of β2m, all or only a fragment of MHC class 1 heavy chain. Of special interest are MHC class 1 heavy chain fragments consisting of, the complete chain minus the intramembrane domain, a chain consisting of only the extracellular α1 and α2 class 1 heavy chain domains, or any of the mentioned β2m and heavy chain fragments containing modified or added designer domain(s) or sequence(s).

Modified MHC I Complexes

MHC I complexes modified in any way as described above, can bind TCR. Modifications include mutations (substitutions, deletions or insertions of natural or non-natural amino acids, or any other organic molecule. The mutations are not limited to those that increase the stability of the MHC complex, and could be introduced anywhere in the MHC complex. One example of special interest is mutations introduced in the α3 subunit of MHC I heavy chain. The α3-subunit interacts with CD8 molecules on the surface of T cells. To minimize binding of MHC multimer to CD8 molecules on the surface of non-specific T cells, amino acids in α3 domain involved in the interaction with CD8 can be mutated. Such a mutation can result in altered or abrogated binding of MHC to CD8 molecules. Another example of special interest is mutations in areas of the β2-domain of MHC II molecules responsible for binding CD4 molecules.

Another embodiment is chemically modified MHC complexes where the chemical modification could be introduced anywhere in the complex, e.g. a MHC complex where the peptide in the peptide-binding cleft has a dinitrophenyl group attached. Modified MHC complexes could also be MHC I or MHC II fusion proteins where the fusion protein is not necessarily more stable than the native protein. Of special interest is MHC complexes fused with genes encoding an amino acid sequence capable of being biotinylated with a Bir A enzyme (Schatz, P. J., (1993), Biotechnology 11(10):1138-1143). This biotinylation sequence could be fused with the COOH-terminal of β2m or the heavy chain of MHC I molecules or the COOH-terminal of either the α-chain or β-chain of MHC II. Similarly, other sequences capable of being enzymatically or chemically modified can be fused to the $NH_2$ or COOH-terminal ends of the MHC complex.

Stabilization of Empty MHC Complexes and MHC-Peptide Complexes

Classical MHC complexes are in nature embedded in the membrane. A preferred embodiment includes multimers comprising a soluble form of MHC where the transmembrane and cytosolic domains of the membrane-anchored MHC complexes are removed. The removal of the membrane-anchoring parts of the molecules can influence the stability of the MHC complexes. The stability of MHC complexes is an important parameter when generating and using MHC multimers.

MHC I complexes consist of a single membrane-anchored heavy chain that contains the complete peptide binding groove and is stable in the soluble form when complexed with β2m. The long-term stability is dependent on the binding of peptide in the peptide-binding groove. Without a peptide in the peptide binding groove the heavy chain and β2m tend to dissociate. Similarly, peptides with high affinity for binding in the peptide-binding groove will typically stabilize the soluble form of the MHC complex while peptides with low affinity for the peptide-binding groove will typically have a smaller stabilizing effect.

In nature MHC I molecules consist of a heavy chain combined with β2m, and a peptide of typically 8-11 amino acids. Herein, MHC I molecules also include molecules consisting of a heavy chain and β2m (empty MHC), or a heavy chain combined with a peptide or a truncated heavy chain comprising α1 and α2 subunits combined with a peptide, or a full-length or truncated heavy chain combined with a full-length or truncated β2m chain. These MHC I molecules can be produced in *E. coli* as recombinant proteins, purified and refolded in vitro (Garboczi et al., (1992), Proc. Natl. Acad. Sci. 89, 3429-33). Alternatively, insect cell systems or mammalian cell systems can be used. To produce stable MHC I complexes and thereby generate reliable MHC I multimers several strategies can be followed. Stabilization strategies for MHC I complexes are described in the following.

Stabilization Strategies for MHC/Complexes

Generation of Covalent Protein-Fusions

MHC I molecules can be stabilized by introduction of one or more linkers between the individual components of the MHC I complex. This could be a complex consisting of a heavy chain fused with β2m through a linker and a soluble peptide, a heavy chain fused to β2m through a linker, a heavy chain/β2m dimer covalently linked to a peptide through a linker to either heavy chain or β2m, and where there can or can not be a linker between the heavy chain and β2m, a heavy chain fused to a peptide through a linker, or the α1 and α2 subunits of the heavy chain fused to a peptide through a linker. In all of these example protein-fusions, each of the heavy chain, β2m and the peptide can be truncated.

The linker could be a flexible linker, e.g. made of glycine and serine and e.g. between 5-20 residues long. The linker could also be rigid with a defined structure, e.g. made of amino acids like glutamate, alanine, lysine, and leucine creating e.g. a more rigid structure.

In heavy chain-β2m fusion proteins the COOH terminus of β2m can be covalently linked to the $NH_2$ terminus of the heavy chain, or the $NH_2$ terminus of β2m can be linked to the COOH terminus of the heavy chain. The fusion-protein can also comprise a β2m domain, or a truncated β2m domain, inserted into the heavy chain, to form a fusion-protein of the form "heavy chain (first part)-β2m-heavy chain (last part)".

Likewise, the fusion-protein can comprise a heavy chain domain, or a truncated heavy chain, inserted into the β2m chain, to form a fusion-protein of the form "β2m (first part)-heavy chain-β2m(last part)".

In peptide-β2m fusion proteins the COOH terminus of the peptide is preferable linked to the $NH_2$ terminus of β2m but the peptide can also be linked to the COOH terminal of β2m via its $NH_2$ terminus. In heavy chain-peptide fusion proteins it is preferred to fuse the $NH_2$ terminus of the heavy chain to the COOH terminus of the peptide, but the fusion can also be between the COOH terminus of the heavy chain and the $NH_2$ terminus of the peptide. In heavy chain-β2m-peptide fusion proteins the $NH_2$ terminus of the heavy chain can be fused to the COOH terminus of β2m and the $NH_2$ terminus of β2m can be fused to the COOH terminus of the peptide.

Non-Covalent Stabilization by Binding to an Unnatural Component

Non-covalent binding of unnatural components to the MHC I complexes can lead to increased stability. The unnatural component can bind to both the heavy chain and the β2m, and in this way promote the assemble of the complex, and/or stabilize the formed complex. Alternatively, the unnatural component can bind to either β2m or heavy chain, and in this way stabilize the polypeptide in its correct conformation, and in this way increase the affinity of the heavy chain for β2m and/or peptide, or increase the affinity of β2m for peptide.

Here, unnatural components mean antibodies, peptides, aptamers or any other molecule with the ability to bind peptides stretches of the MHC complex. Antibody is here to be understood as truncated or full-length antibodies (of isotype IgG, IgM, IgA, IgE), Fab, scFv or bi-Fab fragments or diabodies.

An example of special interest is an antibody binding the MHC I molecule by interaction with the heavy chain as well as β2m. The antibody can be a bispecific antibody that binds with one arm to the heavy chain and the other arm to the β2m of the MHC complex. Alternatively the antibody can be monospecific, and bind at the interface between heavy chain and β2m.

Another example of special interest is an antibody binding the heavy chain but only when the heavy chain is correct folded. Correct folded is here a conformation where the MHC complex is able to bind and present peptide in such a way that a restricted T cell can recognize the MHC-peptide complex and be activated. This type of antibody can be an antibody like the one produced by the clone W6/32 (M0736 from Dako, Denmark) that recognizes a conformational epitope on intact human and some monkey MHC complexes containing β2m, heavy chain and peptide.

Generation of Modified Proteins or Protein Components

One way to improve stability of a MHC I complex am to increase the affinity of the binding peptide for the MHC complex. This can be done by mutation/substitution of amino acids at relevant positions in the peptide, by chemical modifications of amino acids at relevant positions in the peptide or introduction by synthesis of non-natural amino acids at relevant positions in the peptide. Alternatively, mutations, chemical modifications, insertion of natural or non-natural amino acids or deletions could be introduced in the peptide binding cleft, i.e. in the binding pockets that accommodate peptide side chains responsible for anchoring the peptide to the peptide binding cleft. Moreover, reactive groups can be introduced into the antigenic peptide; before, during or upon binding of the peptide, the reactive groups can react with amino acid residues of the peptide binding cleft, thus covalently linking the peptide to the binding pocket.

Mutations/substitutions, chemical modifications, insertion of natural or non-natural amino acids or deletions could also be introduced in the heavy chain and/or β2m at positions outside the peptide-binding cleft. By example, it has been shown that substitution of XX with YY in position nn of human $β_2$m enhance the biochemical stability of MHC Class I molecule complexes and thus may lead to more efficient antigen presentation of subdominant peptide epitopes.

A preferred embodiment is removal of "unwanted cysteine residues" in the heavy chain by mutation, chemical modification, amino acid exchange or deletion. "Unwanted cysteine residues" is here to be understood as cysteines not involved in the correct folding of the final MHC I molecule. The presence of cysteine not directly involved in the formation of correctly folded MHC I molecules can lead to formation of intra molecular disulfide bridges resulting in a non-correct folded MHC complex during in vitro refolding.

Another method for covalent stabilization of MHC I complex am to covalently attach a linker between two of the subunits of the MHC complex. This can be a linker between peptide and heavy chain or between heavy chain and beta2microglobulin.

Other Stabilization of MHC I Complexes

Stabilization with Soluble Additives.

The stability of proteins in aqueous solution depends on the composition of the solution. Addition of salts, detergents organic solvent, polymers etc. can influence the stability. Salts, detergents, organic solvent, polymers and any other soluble additives can be added to increase the stability of MHC complexes. Of special interest are additives that increase surface tension of the MHC molecule without binding the molecule. Examples are sucrose, mannose, glycine, betaine, alanine, glutamine, glutamic acid and ammoniumsulfate. Glycerol, mannitol and sorbitol are also included in this group even though they are able to bind polar regions.

Another group of additives of special interest are able to increase surface tension of the MHC molecule and simultaneously interact with charged groups in the protein. Examples are $MgSO_4$, NaCl, polyethylenglycol, 2-methyl-2,4-pentandiol and guanidiniumsulfate.

Correct formation of MHC complexes is dependent on binding of peptide in the peptide-binding cleft; the bound peptide appears to stabilize the complex in its correct conformation. Addition of molar excess of peptide will force the equilibrium towards correctly folded MHC-peptide complexes. Likewise is excess β2m also expected to drive the folding process in direction of correct folded MHC I complexes. Therefore peptide identical to the peptide bound in the peptide-binding cleft and/or β2m are included as stabilizing soluble additives.

Other additives of special interest for stabilization of MHC molecules are BSA, fetal and bovine calf serum or individual protein components in serum with a protein stabilizing effect.

All of the above mentioned soluble additives can be added to any solution containing MHC complexes in order to increase the stability of the molecule. This can be during the refolding process, to the formed MHC complex, to the soluble MHC monomer, to a solution of MHC multimers comprising one or more MHC complexes or to solutions used during analysis of MHC specific T cells with MHC multimers.

Other additives of special interest for stabilization of MHC molecules are BSA, fetal and bovine calf serum or individual protein components in serum with a protein stabilizing effect.

Chemically Modified MHC/Complexes

There are a number of amino acids that are particularly reactive towards chemical cross linkers. In the following, chemical reactions are described that are particularly preferable for the cross-linking or modification of MHC I complexes.

The amino group at the N-terminal of both chains and of the peptide, as well as amino groups of lysine side chains, are nucleophilic and can be used in a number of chemical reactions, including nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions. Example reagents that can be used in a reaction with the amino groups are activated carboxylic acids such as NHS-ester, tetra and pentafluoro phenolic esters, anhydrides, acid chlorides and fluorides, to form stable amide bonds. Likewise, sulphonyl chlorides can react with these amino groups to form stable sulphone-amides. Iso-Cyanates can also react with amino groups to form stable ureas, and isothiocyanates can be used to introduce thio-urea linkages.

Aldehydes, such as formaldehyde and glutardialdehyde will react with amino groups to form shiffs bases, than can be further reduced to secondary amines. The guanidino group on the side chain of arginine will undergo similar reactions with the same type of reagents.

Another very useful amino acid is cysteine. The thiol on the side chain is readily alkylated by maleimides, vinyl sulphones and halides to form stable thioethers, and reaction with other thiols will give rise to disulphides.

Carboxylic acids at the C-terminal of both chains and peptide, as well as on the side chains of glutamic and aspartic acid, can also be used to introduce cross-links. They will require activation with reagents such as carbodiimides, and can then react with amino groups to give stable amides.

Thus, a large number of chemistries can be employed to form covalent cross-links. The crucial point is that the chemical reagents are bi-functional, being capable of reacting with two amino acid residues.

They can be either homo bi-functional, possessing two identical reactive moieties, such as glutardialdehyde or can be hetero bi-functional with two different reactive moieties, such as GMBS (MaleimidoButyryloxy-Succinimide ester).

Alternatively, two or more reagents can be used; i.e. GMBS can be used to introduce maleimides on the α-chain, and iminothiolane can be used to introduce thiols on the β-chain; the malemide and thiol can then form a thioether link between the two chains.

For the present invention some types of cross-links are particularly useful. The folded MHC-complex can be reacted with dextrans possessing a large number (up to many hundreds) of vinyl sulphones. These can react with lysine residues on both the α and β chains as well as with lysine residues on the peptide protruding from the binding site, effectively cross linking the entire MHC-complex. Such cross linking is indeed a favored reaction because as the first lysine residue reacts with the dextran, the MHC-complex becomes anchored to the dextran favoring further reactions between the MHC complex and the dextran multimerization domain. Another great advantage of this dextran chemistry is that it can be combined with fluorochrome labelling; i.e. the dextran is reacted both with one or several MHC-complexes and one or more fluorescent protein such as APC.

Another valuable approach is to combine the molecular biological tools described above with chemical cross linkers. As an example, one or more lysine residues can be inserted into the α-chain, juxtaposed with glutamic acids in the β-chain, where after the introduced amino groups and carboxylic acids are reacted by addition of carbodiimide. Such reactions are usually not very effective in water, unless as in this case, the groups are well positioned towards reaction. This implies that one avoids excessive reactions that could otherwise end up denaturing or changing the conformation of the MHC-complex.

Likewise a dextran multimerization domain can be cross-linked with appropriately modified MHC-complexes; i.e. one or both chains of the MHC complex can be enriched with lysine residues, increasing reactivity towards the vinylsulphone dextran. The lysine's can be inserted at positions opposite the peptide binding cleft, orienting the MHC-complexes favorably for T-cell recognition.

Another valuable chemical tool is to use extended and flexible cross-linkers. An extended linker will allow the two chains to interact with little or no strain resulting from the linker that connects them, while keeping the chains in the vicinity of each other should the complex dissociate. An excess of peptide should further favour reformation of dissociated MHC-complex.

Multimerization Domain

A number of MHC complexes associate with a multimerization domain to form a MHC multimer. The size of the multimerization domain spans a wide range, from multimerisation domains based on small organic molecule scaffolds to large multimers based on a cellular structure or solid support. The multimerization domain may thus be based on different types of carriers or scaffolds, and likewise, the attachment of MHC complexes to the multimerization domain may involve covalent or non-covalent linkers. Characteristics of different kinds of multimerization domains are described below.

Molecular Weight of Multimerization Domain

In one embodiment the multimerization domain(s) is preferably less than 1,000 Da (small molecule scaffold) . Examples include short peptides (e.g. comprising 10 amino acids), and various small molecule scaffolds (e.g. aromatic ring structures).

In another embodiment the multimerization domain(s) is preferably between 1,000 Da and 10,000 Da (small molecule scaffold, small peptides, small polymers). Examples include polycyclic structures of both aliphatic and aromatic compounds, peptides comprising e.g. 10-100 amino acids, and other polymers such as dextran, polyethylenglycol, and polyureas.

In another embodiment the multimerization domain(s) is between 10,000 Da and 100,000 Da (Small molecule scaffold, polymers e.g. dextran, streptavidin, IgG, pentamer structure). Examples include proteins and large polypeptides, small molecule scaffolds such as steroids, dextran, dimeric streptavidin, and multi-subunit proteins such as used in Pentamers.

In another embodiment the multimerization domain(s) is preferably between 100,000 Da and 1,000,000 Da (Small molecule scaffold, polymers e.g. dextran, streptavidin, IgG, pentamer structure). Typical examples include larger polymers such as dextran (used in e.g. Dextramers), and streptavidin tetramers.

In another embodiment the multimerization domain(s) is preferably larger than 1,000,000 Da (Small molecule scaffold, polymers e.g. dextran, streptavidin, IgG, pentamer structure, cells, liposomes, artificial lipid bilayers, polystyrene beads and other beads. Most examples of this size involve cells or cell-based structures such as micelles and liposomes, as well as beads and other solid supports.

As mentioned elsewhere herein multimerisation domains can comprise carrier molecules, scaffolds or combinations of the two.

Type of Multimerization Domain

In principle any kind of carrier or scaffold can be used as multimerization domain, including any kind of cell, polymer, protein or other molecular structure, or particles and solid supports. Below different types and specific examples of multimerization domains are listed.

Cell. Cells can be used as carriers. Cells can be either alive and mitotic active, alive and mitotic inactive as a result of irradiation or chemically treatment, or the cells may be dead. The MHC expression may be natural (i.e. not stimulated) or may be induced/stimulated by e.g. Inf-γ. Of special interest are natural antigen presenting cells (APCs) such as dendritic cells, macrophages, Kupfer cells, Langerhans cells, B-cells and any MHC expressing cell either naturally expressing, being transfected or being a hybridoma.

Cell-like structures. Cell-like carriers include membrane-based structures carrying MHC-peptide complexes in their membranes such as micelles, liposomes, and other structures of membranes, and phages such as filamentous phages.

Solid support. Solid support includes beads, particulate matters and other surfaces. A preferred embodiment include beads (magnetic or non-magnetic beads) that carry electrophilic groups e.g. divinyl sulfone activated polysaccharide, polystyrene beads that have been functionalized with tosyl-activated esters, magnetic polystyrene beads functionalized with tosyl-activated esters), and where MHC complexes may be covalently immobilized to these by reaction of nucleophiles comprised within the MHC complex with the electrophiles of the beads. Beads may be made of sepharose, sephacryl, polystyrene, agarose, polysaccharide, polycarbamate or any other kind of beads that can be suspended in aqueous buffer.

Another embodiment includes surfaces, i.e. solid supports and particles carrying immobilized MHC complexes on the surface. Of special interest are wells of a microtiter plate or other plate formats, reagent tubes, glass slides or other supports for use in microarray analysis, tubings or channels of micro fluidic chambers or devices, Biacore chips and beads Molecule. Multimerization domains may also be molecules or complexes of molecules held together by non-covalent bonds. The molecules constituting the multimerization domain can be small organic molecules or large polymers, and may be flexible linear molecules or rigid, globular structures such as e.g. proteins. Different kinds of molecules used in multimerization domains are described below.

Small organic molecules. Small organic molecules here includes steroids, peptides, linear or cyclic structures, and aromatic or aliphatic structures, and many others. The prototypical small organic scaffold is a functionalized benzene ring, i.e. a benzene ring functionalized with a number of reactive groups such as amines, to which a number of MHC molecules may be covalently linked. However, the types of reactive groups constituting the linker connecting the MHC complex and the multimerization domain, as well as the type of scaffold structure, can be chosen from a long list of chemical structures. A non-comprehensive list of scaffold structures are listed below.

Typical scaffolds include aromatic structures, benzodiazepines, hydantoins, piperazines, indoles, furans, thiazoles, steroids, diketopiperazines, morpholines, tropanes, coumarines, qinolines, pyrroles, oxazoles, amino acid precursors, cyclic or aromatic ring structures, and many others.

Typical carriers include linear and branched polymers such as peptides, polysaccharides, nucleic acids, and many others. Multimerization domains based on small organic or polymer molecules thus include a wealth of different structures, including small compact molecules, linear structures, polymers, polypeptides, polyureas, polycarbamates, cyclic structures, natural compound derivatives, alpha-, beta-, gamma-, and omega-peptides, mono-, di- and tri-substituted peptides, L- and D-form peptides, cyclohexane- and cyclopentane-backbone modified beta-peptides, vinylogous polypeptides, glycopolypeptides, polyamides, vinylogous sulfonamide peptide, Polysulfonamide-conjugated peptide (i.e., having prosthetic groups), Polyesters, Polysaccharides such as dextran and aminodextran, polycarbamates, polycarbonates, polyureas, poly-peptidylphosphonates, Azatides, peptoids (oligo N-substituted glycines), Polyethers, ethoxyformacetal oligomers, poly-thioethers, polyethylene, glycols (PEG), polyethylenes, polydisulfides, polyarylene sulfides, Polynucleotides, PNAs, LNAs, Morpholinos, oligo pyrrolinone, polyoximes, Polyimines, Polyethyleneimine, Polyacetates, Polystyrenes, Polyacetylene, Polyvinyl, Lipids, Phospholipids, Glycolipids, polycycles, (aliphatic), polycycles (aromatic), polyheterocycles, Proteoglycan, Polysiloxanes, Polyisocyanides, Polyisocyanates, polymethacrylates, Monofunctional, Difunctional, Trifunctional and Oligofunctional open-chain hydrocarbons, Monofunctional, Difunctional, Trifunctional and Oligofunctional Nonaromat Carbocycles, Monocyclic, Bicyclic, Tricyclic and Polycyclic Hydrocarbons, Bridged Polycyclic Hydrocarbones, Monofunctional, Difunctional, Trifunctional and Oligofunctional Nonaromatic, Heterocycles, Monocyclic, Bicyclic, Tricyclic and Polycyclic Heterocycles, bridged Polycyclic Heterocycles, Monofunctional, Difunctional, Trifunctional and Oligofunctional Aromatic Carbocycles, Monocyclic, Bicyclic, Tricyclic and Polycyclic Aromatic Carbocycles, Monofunctional, Difunctional, Trifunctional and Oligofunctional Aromatic Heterocycles. Monocyclic, Bicyclic, Tricyclic and Polycyclic Heterocycles. Chelates, fullerenes, and any combination of the above and many others.

Biological polymers. Biological molecules here include peptides, proteins (including antibodies, coiled-coil helices, streptavidin and many others), nucleic acids such as DNA and RNA, and polysaccharides such as dextran. The biological polymers may be reacted with MHC complexes (e.g. a number of MHC complexes chemically coupled to e.g. the amino groups of a protein), or may be linked through e.g. DNA duplex formation between a carrier DNA molecule and a number of DNA oligonucleotides each coupled to a MHC complex. Another type of multimerization domain based on a biological polymer is the streptavidin-based tetramer, where a streptavidin binds up to four biotinylated MHC complexes, as described above (see Background of the invention).

Self-assembling multimeric structures. Several examples of commercial MHC multimers exist where the multimer is formed through self-assembling. Thus, the Pentamers are formed through formation of a coiled-coil structure that holds together 5 MHC complexes in an apparently planar structure. In a similar way, the Streptamers are based on the Streptactin protein which oligomerizes to form a MHC multimer comprising several MHC complexes (see Background of the invention).

In the following, alternative ways to make MHC multimers based on a molecule multimerization domain are described. They involve one or more of the above-mentioned types of multimerization domains.

MHC dextramers can be made by coupling MHC complexes to dextran via a streptavidin-biotin interaction. In principle, biotin-streptavidin can be replaced by any dimerization domain, where one half of the dimerization domain is coupled to the MHC-peptide complex and the other half is coupled to dextran. For example, an acidic helix (one half of a coiled-coil dimer) is coupled or fused to MHC, and a basic helix (other half of a coiled-coil dimmer) is coupled to dextran. Mixing the two results in MHC binding to dextran by forming the acid/base coiled-coil structure.

Antibodies can be used as scaffolds by using their capacity to bind to a carefully selected antigen found naturally or added as a tag to a part of the MHC molecule not involved in peptide binding. For example, IgG and IgE will be able to bind two MHC molecules, IgM having a pentameric structure will be able to bind 10 MHC molecules.

The antibodies can be full-length or truncated; a standard antibody-fragment includes the Fab2 fragment.

Peptides involved in coiled-coil structures can act as scaffold by making stable dimeric, trimeric, tetrameric and pentameric interactions. Examples hereof are the Fos-Jun heterodimeric coiled coil, the *E. coli* homo-trimeric coiled-coil domain Lpp-56, the engineered Trp-zipper protein forming a discrete, stable, α-helical pentamer in water at physiological pH.

Further examples of suitable scaffolds, carriers and linkers are streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase), glutathione, Calmodulin-binding peptide (CBP), Strep-tag, Cellulose Binding Domain, Maltose Binding Protein, S-Peptide Tag, Chitin Binding Tag, Immunoreactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. Non-limiting examples are streptavidin-biotin and jun-fos. In particular, when the MHC molecule is tagged, the binding entity may be an "anti-tag". By "anti-tag" is meant an antibody binding to the tag, or any other molecule capable of binding to such tag.

MHC complexes can be multimerized by other means than coupling or binding to a multimerization domain. Thus, the multimerization domain may be formed during the multimerization of MHCs. One such method is to extend the bound antigenic peptide with dimerization domains. One end of the antigenic peptide is extended with dimerization domain A (e.g. acidic helix, half of a coiled-coil dimer) and the other end is extended with dimerization domain B (e.g. basic helix, other half of a coiled-coil dimer). When MHC complexes are loaded/mixed with these extended peptides the following multimer structure will be formed: A-MHC-BA-MHC-BA-MHC-B etc. The antigenic peptides in the mixture can either be identical or a mixture of peptides with comparable extended dimerization domains. Alternatively both ends of a peptide are extended with the same dimerization domain A and another peptide (same amino acid sequence or a different amino acid sequence) is extended with dimerization domain B. When MHC and peptides are mixed the following structures are formed: A-MHC-AB-MHC-BA-MHC-AB-MHC-B etc. Multimerization of MHC complexes by extension of peptides are restricted to MHC molecules since the peptide binding groove of MHC I molecules is typically closed in both ends thereby limiting the size of peptide that can be embedded in the groove, and therefore preventing the peptide from extending out of the groove.

Another multimerization approach applicable to MHC complexes is based on extension of the N- and/or C-terminal of the MHC complex. For example the N-terminus of the MHC complex is extended with dimerization domain A and the C-terminus is extended with dimerization domain B. When MHC complexes are incubated together they pair with each other and form multimers like: A-MHC-BA-MHC-BA-MHC-BA-MHC-B etc. Alternatively the N-terminus and the C-terminus of a MHC complex are both extended with dimerization domain A and the N-terminal and C-terminal of another preparation of MHC complex (either the same or a different MHC) are extended with dimerization domain B. When these two types of MHC complexes are incubated together multimers will be formed: A-MHC-AB-MHC-BA-MHC-AB-MHC-B etc.

In all the above-described examples the extension can be either chemically coupled to the peptide/MHC complex or introduced as extension by gene fusion.

Dimerization domain AB can be any molecule pair able to bind to each other, such as acid/base coiled-coil helices, antibody-antigen, DNA-DNA, PNA-PNA, DNA-PNA, DNA-RNA, LNA-DNA, leucine zipper e.g. Fos/Jun, streptavidin-biotin and other molecule pairs as described elsewhere herein.

Linker Molecules

A number of MHC complexes associate with a multimerization domain to form a MHC multimer. The attachment of MHC complexes to the multimerization domain may involve covalent or non-covalent linkers, and may involve small reactive groups as well as large protein-protein interactions.

The coupling of multimerization domains and MHC complexes involve the association of an entity X (attached to or part of the multimerization domain) and an entity Y (attached to or part of the MHC complex). Thus, the linker that connects the multimerization domain and the MHC complex comprises an XY portion.

Covalent linker. The XY linkage can be covalent, in which case X and Y are reactive groups. In this case, X can be a nucleophilic group (such as —$NH_2$, —OH, —SH, —NH—$NH_2$), and Y an electrophilic group (such as CHO, COOH, CO) that react to form a covalent bond XY; or Y can be a nucleophilic group and X an electrophilic group that react to form a covalent bond XY. Other possibilities exist, e.g either of the reactive groups can be a radical, capable of reacting with the other reactive group. A number of reactive groups X and Y, and the bonds that are formed upon reaction of X and Y, are shown in FIG. 5 of WO 2009/106073.

X and Y can be reactive groups naturally comprised within the multimerization domain and/or the MHC complex, or they can be artificially added reactive groups. Thus, linkers containing reactive groups can be linked to either of the multimerization domain and MHC complex; subsequently the introduced reactive group(s) can be used to covalently link the multimerization domain and MHC complex.

Example natural reactive groups of MHC complexes include amino acid side chains comprising —NH$_2$, —OH, —SH, and —NH—. Example natural reactive groups of multimerization domains include hydroxyls of polysaccharides such as dextrans, but also include amino acid side chains comprising —NH$_2$, —OH, —SH, and —NH— of polypeptides, when the polypeptide is used as a multimerization domain. In some MHC multimers, one of the polypeptides of the MHC complex (i.e. the P2M, heavy chain or the antigenic peptide) is linked by a protein fusion to the multimerization domain. Thus, during the translation of the fusion protein, an acyl group (reactive group X or Y) and an amino group (reactive group Y or X) react to form an amide bond. Example MHC multimers where the bond between the multimerization domain and the MHC complex is covalent and results from reaction between natural reactive groups, include MHC-pentamers (described in US patent 2004209295) and MHC-dimers, where the linkage between multimerization domain and MHC complex is in both cases generated during the translation of the fusion protein.

Example artificial reactive groups include reactive groups that are attached to the multimerization domain or MHC complex, through association of a linker molecule comprising the reactive group. The activation of dextran by reaction of the dextran hydroxyls with divinyl sulfone, introduces a reactive vinyl group that can react with e.g. amines of the MHC complex, to form an amine that now links the multimerization domain (the dextran polymer) and the MHC complex. An alternative activation of the dextran multimerization domain involves a multistep reaction that results in the decoration of the dextran with maleimide groups, as described in the patent Siiman et al. U.S. Pat. No. 6,387,622. In this approach, the amino groups of MHC complexes are converted to —SH groups, capable of reacting with the maleimide groups of the activated dextran. Thus, in the latter example, both the reactive group of the multimerization domain (the maleimide) and the reactive group of the MHC complex (the thiol) are artificially introduced.

Sometimes activating reagents are used in order to make the reactive groups more reactive. For example, acids such as glutamate or aspartate can be converted to activated esters by addition of e.g. carbodiimid and NHS or nitrophenol, or by converting the acid moiety to a tosyl-activated ester. The activated ester reacts efficiently with a nucleophile such as —NH$_2$, —SH, —OH, etc.

For the purpose of this invention, the multimerization domains (including small organic scaffold molecules, proteins, protein complexes, polymers, beads, liposomes, micelles, cells) that form a covalent bond with the MHC complexes can be divided into separate groups, depending on the nature of the reactive group that the multimerization domain contains. One group comprise multimerization domains that carry nucleophilic groups (e.g. —NH$_2$, —OH, —SH, —CN, —NH—NH$_2$), exemplified by polysaccharides, polypeptides containing e.g. lysine, serine, and cysteine; another group of multimerization domains carry electrophilic groups (e.g. —COOH, —CHO, —CO, NHS-ester, tosyl-activated ester, and other activated esters, acid-anhydrides), exemplified by polypeptides containing e.g. glutamate and aspartate, or vinyl sulfone activated dextran; yet another group of multimerization domains carry radicals or conjugated double bonds.

The multimerization domains appropriate for this disclosure thus include those that contain any of the reactive groups shown in FIG. 5 of WO 2009/106073 or that can react with other reactive groups to form the bonds shown in FIG. 5 of WO 2009/106073.

Likewise, MHC complexes can be divided into separate groups, depending on the nature of the reactive group comprised within the MHC complex. One group comprise MHCs that carry nucleophilic groups (e.g. —NH$_2$, —OH, —SH, —CN, —NH—NH$_2$), e.g. lysine, serine, and cysteine; another group of MHCs carry electrophilic groups (e.g. —COOH, —CHO, —CO, NHS-ester, tosyl-activated ester, and other activated esters, acid-anhydrides), exemplified by e.g. glutamate and aspartate; yet another group of MHCs carry radicals or conjugated double bonds.

The reactive groups of the MHC complex are either carried by the amino acids of the MHC-peptide complex (and may be comprised by any of the peptides of the MHC-peptide complex, including the antigenic peptide), or alternatively, the reactive group of the MHC complex has been introduced by covalent or non-covalent attachment of a molecule containing the appropriate reactive group.

Preferred reactive groups in this regard include —CSO$_2$OH, phenylchloride, —SH, —SS, aldehydes, hydroxyls, isocyanate, thiols, amines, esters, thioesters, carboxylic acids, triple bonds, double bonds, ethers, acid chlorides, phosphates, imidazoles, halogenated aromatic rings, any precursors thereof, or any protected reactive groups, and many others. Example pairs of reactive groups, and the resulting bonds formed, are shown in FIG. 5 of WO 2009/106073.

Reactions that may be employed include acylation (formation of amide, pyrazolone, isoxazolone, pyrimidine, comarine, quinolinon, phthalhydrazide, diketopiperazine, benzodiazepinone, and hydantoin), alkylation, vinylation, disulfide formation, Wittig reaction, Horner-Wittig-Emmans reaction, arylation (formation of biaryl or vinylarene), condensation reactions, cycloadditions ((2+4), (3+2)), addition to carbon-carbon multiplebonds, cycloaddition to multiple bonds, addition to carbon-hetero multiple bonds, nucleophilic aromatic substitution, transition metal catalyzed reactions, and may involve formation of ethers, thioethers, secondary amines, tertiary amines, beta-hydroxy ethers, beta-hydroxy thioethers, beta-hydroxy amines, beta-amino ethers, amides, thioamides, oximes, sulfonamides, di- and trifunctional compounds, substituted aromatic compounds, vinyl substituted aromatic compounds, alkyn substituted aromatic compounds, biaryl compounds, hydrazines, hydroxylamine ethers, substituted cycloalkenes, substituted cyclodienes, substituted 1, 2, 3 triazoles, substituted cycloalkenes, beta-hydroxy ketones, beta-hydroxy aldehydes, vinyl ketones, vinyl aldehydes, substituted alkenes, substituted alkenes, substituted amines, and many others.

MHC dextramers can be made by covalent coupling of MHC complexes to the dextran backbone, e.g. by chemical coupling of MHC complexes to dextran backbones. The MHC complexes can be coupled through either heavy chain or β2-microglobulin if the MHC complexes are MHC I or through α-chain or β-chain if the MHC complexes are MHC II. MHC complexes can be coupled as folded complexes comprising heavy chain/beta2microglobulin or α-chain/β-chain or either combination together with peptide in the peptide-binding cleft. Alternatively either of the protein chains can be coupled to dextran and then folded in vitro together with the other chain of the MHC complex not coupled to dextran and together with peptide. Direct coupling of MHC complexes to dextran multimerization domain can be via an amino group or via a sulphide group. Either group can be a natural component of the MHC complex or attached to the MHC complex chemically. Alternatively, a cysteine may be introduced into the genes of either chain of the MHC complex.

Another way to covalently link MHC complexes to dextran multimerization domains is to use the antigenic peptide as a linker between MHC and dextran. Linker containing antigenic peptide at one end is coupled to dextran. Antigenic peptide here means a peptide able to bind MHC complexes in the peptide-binding cleft. As an example, 10 or more antigenic peptides may be coupled to one dextran molecule. When MHC complexes are added to such peptide-dextran construct the MHC complexes will bind the antigenic peptides and thereby MHC-peptide complexes are displayed around the dextran multimerization domain. The antigenic peptides can be identical or different from each other. Similarly MHC complexes can be either identical or different from each other as long as they are capable of binding one or more of the peptides on the dextran multimerization domain.

Non-covalent linker. The linker that connects the multimerization domain and the MHC complex comprises an XY portion. Above different kinds of covalent linkages XY were described. However, the XY linkage can also be non-covalent. Non-covalent XY linkages can comprise natural dimerization pairs such as antigen-antibody pairs, DNA-DNA interactions, or can include natural interactions between small molecules and proteins, e.g. between biotin and streptavidin. Artificial XY examples include XY pairs such as $His_6$ tag (X) interacting with Ni-NTA (Y) and PNA-PNA interations.

Protein-protein interactions. The non-covalent linker may comprise a complex of two or more polypeptides or proteins, held together by non-covalent interactions. Example polypeptides and proteins belonging to this group include Fos/Jun, Acid/Base coiled coil structure, antibody/antigen (where the antigen is a peptide), and many others.

A preferred embodiment involving non-covalent interactions between polypeptides and/or proteins are represented by the Pentamer structure described in US patent 2004209295.

Another preferred embodiment involves the use of antibodies, with affinity for the surface of MHC opposite to the peptide-binding groove. Thus, an anti-MHC antibody, with its two binding site, will bind two MHC complexes and in this way generate a bivalent MHC multimer. In addition, the antibody can stabilize the MHC complex through the binding interactions. This is particularly relevant for MHC class II complexes, as these are less stable than class I MHC complexes.

Polynucleotide-polynucleotide interactions. The non-covalent linker may comprise nucleotides that interact non-covalently. Example interactions include PNA/PNA, DNA/DNA, RNA/RNA, LNA/DNA, and any other nucleic acid duplex structure, and any combination of such natural and unnatural polynucleotides such as DNA/PNA, RNA/DNA, and PNA/LNA.

Protein-small molecule interactions. The non-covalent linker may comprise a macromolecule (e.g. protein, polynucleotide) and a small molecule ligand of the macromolecule. The interaction may be natural (i.e., found in Nature, such as the Streptavidin/biotin interaction) or non-natural (e.g. His-tag peptide/Ni-NTA interaction). Example interactions include Streptavidin/biotin and anti-biotin antibody/biotin.

Combinations—non-covalent linker molecules. Other combinations of proteins, polynucleotides, small organic molecules, and other molecules, may be used to link the MHC to the multimerization domain. These other combinations include protein-DNA interactions (e.g. DNA binding protein such as the gene regulatory protein CRP interacting with its DNA recognition sequence), RNA aptamer-protein interactions (e.g. RNA aptamer specific for growth hormone interacting with growth hormone)

Synthetic molecule-synthetic molecule interaction. The non-covalent linker may comprise a complex of two or more organic molecules, held together by non-covalent interactions. Example interactions are two chelate molecules binding to the same metal ion (e.g. EDTA-$Ni^{++}$-NTA), or a short polyhistidine peptide (e.g. Hiss) bound to NTA-$Ni^{++}$.

In another preferred embodiment the multimerization domain is a bead. The bead is covalently or non-covalently coated with MHC multimers or single MHC complexes, through non-cleavable or cleavable linkers. As an example, the bead can be coated with streptavidin monomers, which in turn are associated with biotinylated MHC complexes; or the bead can be coated with streptavidin tetramers, each of which are associated with 0, 1, 2, 3, or 4 biotinylated MHC complexes; or the bead can be coated with MHC-dextramers where e.g. the reactive groups of the MHC-dextramer (e.g. the divinyl sulfone-activated dextran backbone) has reacted with nucleophilic groups on the bead, to form a covalent linkage between the dextran of the dextramer and the beads.

In another preferred embodiment, the MHC multimers described above (e.g. where the multimerization domain is a bead) further contains a flexible or rigid, and water soluble, linker that allows for the immobilized MHC complexes to interact efficiently with cells, such as T-cells with affinity for the MHC complexes. In yet another embodiment, the linker is cleavable, allowing for release of the MHC complexes from the bead. If T-cells have been immobilized, by binding to the MHC complexes, the T-cells can very gently be released by cleavage of this cleavable linker. Appropriate cleavable linkers are shown in FIG. 6 of WO 2009/106073. Most preferably, the linker is cleaved at physiological conditions, allowing for the integrity of the isolated cells.

Further examples of linker molecules that may be employed in the present invention include Calmodulin-binding peptide (CBP), 6×HIS, Protein A, Protein G, biotin, Avidin, Streptavidin, Strep-tag, Cellulose Binding Domain, Maltose Binding Protein, S-Peptide Tag, Chitin Binding Tag, Immuno-reactive Epitopes, Epitope Tags, GST tagged proteins, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope.

The list of dimerization- and multimerization domains, described elsewhere in this document, define alternative non-covalent linkers between the multimerization domain and the MHC complex.

The abovementioned dimerization- and multimerization domains represent specific binding interactions. Another type of non-covalent interactions involves the non-specific adsorption of e.g. proteins onto surfaces. As an example, the non-covalent adsorption of proteins onto glass beads represents this class of XY interactions. Likewise, the interaction of MHC complexes (comprising full-length polypeptide chains, including the transmembrane portion) with the cell membrane of for example dendritic cells is an example of a non-covalent, primarily non-specific XY interaction.

In some of the abovementioned embodiments, several multimerization domains (e.g. streptavidin tetramers bound to biotinylated MHC complexes) are linked to another multimerization domain (e.g. the bead). For the purpose of this disclosure we shall call both the smaller and the bigger multimerization domain, as well as the combined multimerization domain, for multimerization domain.

Additional Features of MHC Multimer, Antigenic Peptide or Antigenic Polypeptide Product Additional components may be coupled to carrier or added as individual components not coupled to carrier.

Attachment of Biologically Active Molecules to MHC Multimers

Engagement of MHC complex to the specific T cell receptor leads to a signalling cascade in the T cell. However, T-cells normally respond to a single signal stimulus by going into apoptosis. T cells needs a second signal in order to become activated and start development into a specific activation state e.g. become an active cytotoxic T cell, helper T cell or regulatory T cell.

It is to be understood that the MHC multimer of the invention may further comprise one or more additional substituents. The definition of the terms "one or more", "a plurality", "a", "an", and "the" also apply here. Such biologically active molecules may be attached to the construct in order to affect the characteristics of the constructs, e.g. with respect to binding properties, effects, MHC molecule specificities, solubility, stability, or detectability. For instance, spacing could be provided between the MHC complexes, one or both chromophores of a Fluorescence Resonance Energy Transfer (FRET) donor/acceptor pair could be inserted, functional groups could be attached, or groups having a biological activity could be attached.

MHC multimers can be covalently or non-covalently associated with various molecules: having adjuvant effects; being immune targets e.g. antigens; having biological activity e.g. enzymes, regulators of receptor activity, receptor ligands, immune potentiators, drugs, toxins, co-receptors, proteins and peptides in general; sugar moieties; lipid groups; nucleic acids including siRNA; nano particles; small molecules. In the following these molecules are collectively called biologically active molecules. Such molecules can be attached to the MHC multimer using the same principles as those described for attachment of MHC complexes to multimerisation domains as described elsewhere herein. In brief, attachment can be done by chemical reactions between reactive groups on the biologically active molecule and reactive groups of the multimerisation domain and/or between reactive groups on the biologically active molecule and reactive groups of the MHC-peptide complex. Alternatively, attachment is done by non-covalent interaction between part of the multimerisation domain and part of the biological active molecule or between part of the MHC-peptide complex and part of the biological active molecule. In both covalent and non-covalent attachment of the biologically molecule to the multimerisation domain a linker molecule can connect the two. The linker molecule can be covalent or non-covalent attached to both molecules. Examples of linker molecules are described elsewhere herein. Some of the MHCmer structures better allows these kind of modifications than others.

Biological active molecules can be attached repetitively aiding to recognition by and stimulation of the innate immune system via Toll or other receptors.

MHC multimers carrying one or more additional groups can be used as therapeutic or vaccine reagents.

In particular, the biologically active molecule may be selected from:

proteins such as MHC Class I-like proteins like MIC A, MIC B, CD1d, HLA E, HLA F, HLA G, HLA H, ULBP-1, ULBP-2, and ULBP-3, co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells, cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin, accessory molecules such as LFA-1, CD11a/18, CD54 (ICAM-1), CD106 (VCAM), and CD49a,b,c,d,e,f/CD29 (VLA-4), adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P, toxic molecules selected from toxins, enzymes, antibodies, radioisotopes, chemiluminescent substances, bioluminescent substances, polymers, metal particles, and haptens, such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin, and combinations of any of the foregoing, as well as antibodies (monoclonal, polyclonal, and recombinant) to the foregoing, where relevant. Antibody derivatives or fragments thereof may also be used.

Biological active molecules as described above may also be attached to antigenic peptide products or antigenic polypeptide products using same principles for attachment.

Design and Generation of Product to be Used for Immune Monitoring, Diagnosis, Therapy or Vaccination The product of the present invention may be used for immune monitoring, diagnosis, therapy and/or vaccination. The generation of product may follow some or all of the following general steps:
1. Design of antigenic peptides
2. Choice of MHC allele
3. Generation of product
4. Validation and optimization of product Production of a MHC Multimer, Antigenic Peptide or Antigenic Polypeptide Diagnostic or Immune Monitoring Reagent May Follow Some or all of the Following Steps.
1. Identify disease of interest: *Borrelia* infection
2. Identify relevant protein antigen(s): *Borrelia* antigenic polypeptide OppA, DbpA, FlhF, FlaB and P37-42
3. Identify the protein sequence. Amino acid sequences can be directly found in databases or deduced from gene- or mRNA sequence e.g. using the following link http://www.ncbi.nlm.nih.gov/Genbank/index.html. If not in databases relevant proteins or genes encoding relevant proteins may be isolated and sequenced. In some cases only DNA sequences will be available without knowing which part of the sequence is protein coding. Then the DNA sequence is translated into amino acid sequence in all reading frames.
4. Choose MHC allele(s). Decide on needed MHC allele population coverage. If a broad coverage of a given population is needed (i.e. when a generally applicable reagents are sought) the most frequently expressed MHC alleles by the population of interest may be chosen e.g. using the database http://www.allelefrequencies.net/test/default1.asp or http://epitope.liai.org:8080/tools/population/iedb_input.
   In case of personalized medicine the patient is tissue typed (HLA type) and then MHC alleles may be selected according to that.
5. Run the general peptide epitope generator program described elsewhere herein on all selected amino acid sequences from step 3, thereby generating all possible epitopes of defined length.
6. If searching for broadly applicable epitope sequences, a good alternative to step 5 is to run the "intelligent" peptide epitope prediction programs on the selected amino acid sequences of step 3 using the selected MHC alleles from step 4 e.g. using epitope prediction programs like http://www.syfpeithi.de/, http://www.cbs.dtu.dk/services/NetMHC/, and http://www.cbs.dtu.dk/services/NetMHCII/.
   This step can also be used supplementary to step 5 by running selected or all epitopes from the general peptide epitope generator program through one or more of the intelligent peptide epitope prediction programs.
7. If searching for broadly applicable epitope sequences, one may choose to select the epitopes with highest binding score, or the most likely proteolytic products of the species in question for the chosen MHC alleles and run them through the BLAST program (http://www.ncbi.nlm.nih.gov/blast/Blast.cgi) to validate the uniqueness of the peptides. If the peptide sequences are present in other species, evaluate the potential risk of disease states caused by the non-relevant species in relation to causing false positive results. If considered being a potential problem for evaluating the future analysis outcome, leave out the peptide. Preferably, choose unique peptide sequences only present in the selected protein.
8. Produce selected peptides as described elsewhere herein, e.g. by standard organic synthesis, and optionally test for binding to the desired MHC alleles by e.g in vitro folding, peptide exchange of already preloaded MHC complexes or another method able to test for peptide binding to MHC molecules.
9. Generate desired MHC multimer by covalently or non-covalently attaching MHC-peptide complex(es) to multimerization domain, and optionally attach a fluorophore to the MHC multimer, as described elsewhere herein. Optionally, test efficacy in detecting specific T-cells using e.g. the methods described in the section "Detection".

The MHC multimer reagents may be used in a diagnostic procedure or kit for testing patient and control samples e.g. by flow cytometry, immune histochemistry, Elispot or other methods as described herein.

In some applications it is desirable to identify epitopes that covers several species and/or strains. If a protein from *Borrelia* bacteria is very heterologous among *Borrelia* strains the amino acid sequence of this protein isolated from different *Borrelia* isolates varies. In such cases the amino acid sequence from several species and/or strains can be aligned e.g. using protein alignment programs (e.g. Vector NTI from Invitrogen) and a homologous sequence for all species and/or strains can be identified. This homologous sequence can be run through the general peptide epitope generator program and/or the "intelligent" peptide epitope prediction programs as described above to identify epitopes able to bind selected MHC alleles. The identified epitope may not necessarily have 100% homology to amino acid stretches in any of the proteins selected for alignment. The selected epitopes can be used for generation of MHC multimer diagnostic, immune monitoring or therapeutic reagents.

Methods for Generating Panels of MHC Multimers

The present disclosure is also directed to generating MHC multimers for detecting and analysing receptors on MHC-peptide recognising cells, such as epitope specific T-cell clones or other immune competent effector cells.

It is thus an aspect to provide a method for generating the MHC multimers in the panels and pools comprising said MHC multimers according to the present disclosure, said method comprising one or more steps of
i) providing one or more antigenic peptides P derived from a *Borrelia* antigenic polypeptide selected from the group consisting of OppA, DbpA, FlhF, FlaB and P37-42 as disclosed herein elsewhere,
ii) providing one or more functional MHC proteins,
iii) providing one or more multimerization domains, and
iv) contacting or reacting the one or more peptides P and the one or more functional MHC proteins and the one or more multimerization domains simultaneously or sequentially in any order, thereby obtaining said MHC multimers.

In one embodiment there is provided a method for generating the MHC multimers according to the present disclosure, said method comprising one or more steps of
i) providing one or more antigenic peptides P derived from a *Borrelia* antigenic polypeptide selected from the group consisting of OppA, DbpA, FlhF, FlaB and P37-42;

ii) providing one or more functional MHC proteins (a-b) capable of binding peptide P, wherein each functional MHC protein is associated with one or more multimerization domains; and iii) contacting or reacting the one or more peptides P and the one or more functional MHC proteins associated with one or more multimerization domains thereby obtaining said MHC multimers.

In another embodiment there is provided a method for generating the MHC multimers according to the present disclosure, said method comprising one or more steps of i) providing one or more MHC-peptide complexes (a-b-P) comprising a functional MHC protein (a-b) bound to peptide P, wherein each MHC-peptide complex comprises an antigenic peptide P derived from a *Borrelia* antigenic polypeptide selected from the group consisting of OppA, DbpA, FlhF, FlaB and P37-42;

ii) providing one or more multimerization domains, and iii) contacting or reacting the one or more MHC-peptide complexes and the one or more multimerization domains thereby obtaining said MHC multimers.

In one embodiment said methods for generating the MHC multimers comprise providing one or more multimerization domains, or providing one or more functional MHC proteins associated with one or more multimerization domains, wherein said one or more multimerization domains is defined as disclosed herein elsewhere.

In a particular aspect, said one or more multimerization domains comprises one or more biological cells and/or cell-like structures, membranes, liposomes and/or micelles; wherein said one or more biological cells in one embodiment is selected from the group consisting of:

i) antigen presenting cells, dendritic cells, macrophages, Kupfer cells, Langerhans cells B-cells, ii) alive and mitotic active; alive and mitotic inactive; or dead cells, iii) cells with a natural expression of MHC; or that have to be induced/stimulated to express MHC, and/or iv) MHC expressing cells, one or more transfected cells expressing MHC or one or more hybridoma cells expressing MHC.

In one embodiment said methods for generating the MHC multimers comprise providing one or more antigenic peptides P which are selected from the group consisting of 8-, 9-, 10,- 11-, and 12-mer peptides that binds to MHC Class I, such as wherein said one or more antigenic peptides P are derived from a *Borrelia* antigenic polypeptide selected from the group consisting of OppA (SEQ ID NOs:1-9), DbpA (SEQ ID NOs:10-20), FlhF (SEQ ID NOs:21-28), FlaB (SEQ ID NOs:29-37), and P37-42 (SEQ ID NOs:38-39).

In one embodiment there is provided methods for generating one or more MHC multimers each MHC multimer comprising an antigenic peptide P selected from the group consisting of i) antigenic peptides P derived from *Borrelia* antigenic polypeptide OppA (SEQ ID NOs:1-9) listed in Table A (Table A-1 to Table A-20), ii) antigenic peptides P derived from *Borrelia* antigenic polypeptide DbpA (SEQ ID NOs:10-20) listed in Table B (Table B-1 to Table B-19), iii) antigenic peptides P derived from *Borrelia* antigenic polypeptide FlhF (SEQ ID NOs:21-28) listed in Table C (Table C-1 to Table C-20), iv) antigenic peptides P derived from *Borrelia* antigenic polypeptide FlaB (SEQ ID NOs:29-37) listed in Table D (Table D-1 to Table D-20), and/or v) antigenic peptides P derived from *Borrelia* antigenic polypeptide P37-42 (SEQ ID NOS:38-39) listed in Table E (Table E-1 to Table E-20).

Also provided are methods for confirming the antigenicity of an antigenic peptide P and/or determining the sequence of an antigenic peptide P, thereby confirming or generating one or more optionally modified peptides P of general utility in diagnosing or treating a disease in an individual.

In one embodiment the methods for generating MHC multimers comprise the further step of confirming the antigenicity of antigenic peptide P and/or determining the sequence of antigenic peptide P, said method comprising the steps of i) selecting one or more MHC Class I alleles;

ii) obtaining and optionally identifying one or more peptides P of a predetermined length derived from a specific protein, and iii) assaying the association formed between a) said one or more peptides P, when forming part of a functional MHC protein in a MHC multimer, and b) a T-cell receptor representative of the selected MHC Class I allele, and iv) optionally modifying said one or more peptides P.

In one embodiment the identification of the one or more peptides P derived from a specific protein for a given MHC allele comprises computational analysis using prediction software.

In one embodiment the identification of the one or more peptides P derived from a identification of the one or more peptides P derived from a specific protein for a given MHC allele comprises computational analysis of the prediction of theoretical binding affinity of the peptide P to the MHC (HLA) molecules using prediction software.

In one embodiment the identification of the one or more peptides P derived from a identification of the one or more peptides P derived from a specific protein for a given MHC allele comprises computational analysis of the prediction of a rank score relative binding strength of the peptide P to the one or more MHC Class I alleles with a relative binding strength threshold (% Rank).

In one embodiment the identification of the one or more peptides P derived from a the computational analysis comprises prediction of MHC Class I binding peptides P derived from a *Borrelia* antigenic polypeptide selected from the group consisting of OppA, DbpA, FlhF, FlaB and P37-42.

Methods Involving Panels of MHC Multimers and Antigenic Peptides

It is an aspect of the present disclosure to determine binding of MHC multimers provided in panels as defined herein with MHC-peptide recognising cells in a sample, such as a sample suspected of comprising MHC-peptide recognising cells.

As used everywhere herein, the term "MHC-peptide recognising cells" are intended to mean cells which are able to recognise and bind to MHC multimers. The intended meaning of "MHC multimers" is given above. MHC-peptide recognising cells may also be called MHC-peptide recognising cell clones, target cells, target MHC-peptide recognising cells, target MHC molecule recognising cells, MHC molecule receptors, MHC receptors, MHC peptide specific receptors, or peptide-specific cells. The term "MHC-peptide recognising cells" is intended to include all subsets of normal, abnormal and defect cells, which recognise and bind to the MHC molecule. Actually, it is the receptor on the MHC-peptide recognising cell that binds to the MHC molecule.

In diseases and various conditions peptides are displayed by means of MHC multimers, which are recognised by the immune system, and cells targeting such MHC multimers are produced (MHC-peptide recognising cells). Thus, the presence of such MHC protein recognising cells is a direct indication of the presence of MHC multimers displaying the peptides recognised by the MHC protein recognising cells. The peptides displayed are indicative and may be involved in various diseases and conditions.

The MHC multimers and antigenic peptides of the present disclosure have numerous uses and are a valuable and powerful tools e.g. in the fields of therapy, diagnosis, prognosis, monitoring, stratification, and determining the status of diseases or conditions. Thus, the MHC multimers and antigenic peptides may be applied in the various methods involving the detection of MHC-peptide recognising cells and in a number of applications, including analyses such as flow cytometry, immunohistochemistry (IHC), and ELISA-like analyses.

The present disclosure also relates generally to the field of therapy. Thus, the present disclosure relates per se to the antigenic peptides and/or the panels of MHC multimers as defined herein for use as medicaments, and for use in in vivo and ex vivo therapy.

The present disclosure relates to therapeutic compositions comprising as active ingredients the panels of MHC multimers and/or the antigenic peptides as defined herein, as well as effective amounts of MHC-peptide recognising cells obtained using the MHC multimers as defined herein to isolate relevant MHC-peptide recognising cells.

The present disclosure in one embodiment relates to methods for detecting the presence of MHC-peptide recognising cells in a sample comprising one or more steps of:
(a) providing a sample suspected of comprising MHC-peptide recognising cells,
(b) contacting the sample with a panel of MHC multimers as defined above, and
(c) determining binding of the MHC multimer to MHC-peptide recognising cells in said sample,
or
(a) providing a sample suspected of comprising MHC-peptide recognising cells,
(b) contacting the sample with a panel of antigenic peptides as defined herein, and
(c) determining binding of the MHC multimers generated as a consequence of addition of antigenic peptide, wherein binding indicates the presence of MHC-peptide recognising cells in said sample.

Methods for detecting the presence of MHC-peptide recognising cells in a sample are a powerful tool in diagnosing disease. Establishing a diagnosis is important in several ways. A diagnosis provides information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC-peptide recognising cells, and thus treatment can be targeted effectively against a particular subtype). In this way, it may also be possible to gain information about aberrant cells, which emerge through the progress of the disease or condition, or to investigate whether and how T-cell specificity is affected. The binding of the MHC multimer makes possible these options, since the binding is indicative for the presence of the MHC-peptide recognising cells in the sample, and accordingly the presence of MHC multimers displaying the peptide.

The methods for detecting the presence of MHC-peptide recognising cells are in one embodiment employed as a method of monitoring MHC-peptide recognising cells.

Methods of monitoring MHC-peptide recognising cells are a powerful tool in monitoring the progress of a disease, e.g. to closely follow the effect of a treatment. The method can i.a. be used to manage or control the disease in a better way, to ensure the patient receives the optimum treatment regime, to adjust the treatment, to confirm remission or recurrence, and to ensure the patient is not treated with a medicament which does not cure or alleviate the disease. In this way, it may also be possible to monitor aberrant cells, which emerge through the progress of the disease or condition, or to investigate whether and how T-cell specificity is affected during treatment. The binding of the MHC multimer makes these options possible, since the binding is indicative for the presence of the MHC-peptide recognising cells in the sample, and accordingly the presence of MHC multimers displaying the peptide.

The methods for detecting the presence of MHC-peptide recognising cells are in one embodiment employed as a method of establishing a prognosis of a disease involving MHC-peptide recognising cells.

Methods of establishing a prognosis of a disease involving MHC-peptide recognising cells are a valuable tool in order to manage diseases, i.a. to ensure the patient is not treated without effect, to ensure the disease is treated in the optimum way, and to predict the chances of survival or cure. In this way, it may also be possible to gain information about aberrant cells, which emerge through the progress of the disease or condition, or to investigate whether and how T-cell specificity is affected, thereby being able to establish a prognosis. The binding of the MHC multimer makes possible these options, since the binding is indicative for the presence of the MHC-peptide recognising cells in the sample, and accordingly the presence of MHC-peptide complexes displaying the peptide.

The methods for detecting the presence of MHC-peptide recognising cells are in one embodiment employed as a method for determining the status of a disease involving MHC-peptide recognising cells.

Methods for determining the status of a disease involving MHC-peptide recognising cells are a valuable tool in managing and controlling disease. A disease could, e.g. change from one stage to another, and thus it is important to be able to determine the disease status. In this way, it may also be possible to gain information about aberrant cells which emerge through the progress of the disease or condition, or to investigate whether and how T-cell specificity is affected, thereby determining the status of a disease or condition. The binding of the MHC-peptide complex makes possible these options, since the binding is indicative for the presence of the MHC-peptide recognising cells in the sample, and accordingly the presence of MHC-peptide complexes displaying the peptide.

The methods for detecting the presence of MHC-peptide recognising cells are in one embodiment employed as a method for determining the effectiveness of a medicament against a disease involving MHC-peptide recognising cells.

Method for determining the effectiveness of a medicament against a disease involving MHC-peptide recognising cells are a valuable tool in several ways. The methods may be used to determine whether a treatment is effectively combating the disease. The method may also provide information about aberrant cells which emerge through the progress of the disease or condition as well as whether and how T-cell specificity is affected, thereby providing information of the effectiveness of a medicament in question. The binding of the MHC multimer makes possible these options, since the binding is indicative for the presence of the MHC-peptide recognising cells in the sample, and accordingly the presence of MHC multimers displaying the peptide.

The methods for detecting the presence of MHC-peptide recognising cells are in one embodiment employed as a method of correlating cellular morphology with the presence of MHC-peptide recognising cells in a sample Such methods are especially valuable as applied in the field of histochemical methods, as the binding pattern and distribution of the MHC multimers can be observed directly.

In such methods, the sample is treated so as to preserve the morphology of the individual cells of the sample. The information gained is important i.a. in diagnostic procedures as sites affected can be observed directly.

The present disclosure in one embodiment relates to methods for manipulating MHC-peptide recognising cell populations comprising one or more steps of:
  (a) providing a sample comprising MHC-peptide recognising cells,
  (b) contacting the sample with a panel of MHC multimers as defined above immobilised onto a solid support,
  (c) isolating the relevant MHC-peptide recognising cells, and
  (d) expanding such cells to a clinically relevant number, with or without further manipulation.

Such ex vivo methods are a powerful tool to generate antigen-specific, long-lived human effector T-cell populations that, when re-introduced to the subject, enable killing of target cells and has a great potential for use in immunotherapy applications against various types of infectious diseases.

The disclosure also relates to methods for obtaining MHC-peptide recognising cells by using the MHC multimers as described herein.

The methods for detecting the presence of MHC-peptide recognising cells are in one embodiment employed as a method for the diagnosis of a disease involving MHC-peptide recognising cells Such diagnostic methods are a powerful tool in the diagnosis of disease. Establishing a diagnosis is important in several ways. A diagnosis gives information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC-peptide recognising cells, and thus treatment can be targeted effectively against a particular subtype). Valuable information may also be obtained about aberrant cells emerging through the progress of the disease or condition as well as whether and how T-cell specificity is affected. The binding of the MHC multimer makes possible these options, since the binding is indicative for the presence of the MHC-peptide recognising cells in the sample, and accordingly the presence of MHC multimers displaying the peptide.

Vaccine

It is a further object of the present disclosure to provide new and powerful strategies for the development of curative vaccines. This in turn will improve the possibilities for directed and efficient immune manipulations against diseases such as infection by pathogenic agent like bacteria. The ability to generate and optionally attach recombinant MHC multimers to multimerization domains, such as scaffolds and/or carrier molecules, will enable the development of a novel analytical and therapeutic tool for monitoring immune responses and contribute to a rational platform for novel therapy and "vaccine" applications.

Therapeutic compositions (e.g. "therapeutic vaccines") that stimulate specific T-cell proliferation by peptide-specific stimulation is indeed a possibility within the present invention. Thus, quantitative analysis and ligand-based detection of specific T-cells that proliferate by the peptide specific stimulation should be performed simultaneously to monitoring the generated response.

It is thus an aspect of the present disclosure to provide a vaccine comprising a panel comprising one or more MHC multimers as described herein; and a vaccine comprising a panel comprising one or more pools of MHC multimers as described herein.

In one embodiment said vaccine further comprises one or more cells, wherein the one or more cells are selected from the group consisting of: cells expressing MHC molecules and cells expressing MHC molecules that have been loaded with one or more antigenic peptides P according to the present disclosure.

For the purpose of making vaccines it can be desirable to employ MHC multimers that comprise a polymer such as dextran, or that are cell-based (e.g. specialized dendritic cells such as described by Banchereau and Palucka, Nature Reviews, Immunology, 2005, vol. 5, p. 296-306).

Preventive vaccination leading to prophylaxis/sterile immunity by inducing memory in the immune system may be obtained by immunizing/vaccinating an individual or animal with MHC alone, or with MHC in combination with other molecules as mentioned elsewhere herein.

Therapeutic vaccination i.e. vaccination "teaching" the immune system to fight an existing infection or disease, may be obtained by immunizing/vaccinating an individual or animal with MHC alone, or with MHC in combination with other molecules including e,g. adjuvant(s)

Application of Methods Involving Panels of MHC Multimers and Antigenic Peptides

MHC multimers and antigenic peptides as described herein can be used to identify and isolate specific T cells in a wide array of applications. In principle all kind of samples possessing T cells can be analysed using MHC multimers and/or antigenic peptides creating one or more MHC multimers in sample.

MHC multimers detect antigen-specific T cells of the various T cell subsets. T cells are pivotal for mounting an adaptive immune response. It is therefore of importance to be able to measure the number of specific T cells when performing a monitoring of a given immune response. Typically, the adaptive immune response is monitored by measuring the specific antibody response, which is only one of the effector arms of the immune system. This can lead to miss-interpretation of the actual clinical immune status.

In many cases intruders of the organism can hide away inside the cells, which cannot provoke a humoral response. In other cases, e.g. in the case of certain viruses the intruder mutates fast, particularly in the genes encoding the proteins that are targets for the humoral response. Examples include the influenza and HIV viruses. The high rate of mutagenesis renders the humoral response unable to cope with the infection. In these cases the immune system relies on the cellular immune response. When developing vaccines against such targets one needs to provoke the cellular response in order to get an efficient vaccine.

MHC multimers and/or antigenic peptides can be used for monitoring immune responses elicited by vaccines.

One embodiment of the present disclosure is monitoring the effect of vaccines against infectious disease, e.g. vaccines against Lyme Borreliosis. Lyme Borreliosis is a dangerous, multisystem and multi-organ disease caused by infection with the bacterial spirochete *Borrelia* and therefore the possibilities of prophylaxis are of great importance. Many *Borrelia* vaccines aim at eliciting an antibody response, but since the *Borrelia* bacteria have proven to be able to go inside cells a vaccine eliciting a cellular cytotoxic response is desirable. MHC multimers can be used to monitor the effectiveness of such a vaccine, where MHC multimers are any MHC multimer that can be added to a sample or one or more MHC multimers generated in sample by addition of antigenic peptide.

MHC multimers and/or antigenic polypeptides themselves can also be valuable as a *Borrelia* vaccine in order to elicit a cellular immune response. In one embodiment of the present disclosure MHC multimers having many MHC molecules attached to the multimerisation domain are used as vaccine. Such MHC multimers are able to bind several TCR simultaneously thereby crosslinking the receptors resulting in activation of the T cell in question. Example MHC multimers useful as vaccine are MHC dextramers where many MHC molecules are coupled to dextran. In principle any MHC multimer as described elsewhere herein that are able to bind several TCR's simultaneously can be used.

In another embodiment of the present disclosure antigenic peptides are used as a vaccine eliciting a T cell responses directed against the peptide(s). Following administration of such vaccine antigenic peptides are taken up by antigen presenting cells, processed inside cell and displayed as MHC-peptide complexes on the surface of the antigen presenting cells thereby generating cell-based MHC multimers in sample. Such antigen presenting cells displaying antigenic peptide by MHC molecules may then bind TCR on antigen specific T cells and elicit a specific T cell immune response against the antigenic peptides.

In a *Borrelia* vaccine the antigenic peptides used as vaccine themselves or bound in the peptide binding cleft of MHC molecules in MHC multimers are derived from antigenic *Borrelia* proteins, such as a *Borrelia* antigenic polypeptide selected from the group consisting of OppA, DbpA, FlhF, FlaB and P37-42.

To further enhance the MHC-peptide specific stimulation of the T cell bound, T cell stimulatory molecules can be coupled to the multimerisation domain together with MHC or may be added as soluble adjuvant together with the MHC multimer, antigenic peptide and/or antigenic polypeptide. Example T cell stimulatory molecules include but are not limited to IL-2, CD80 (B7.1), CD86 (B7.2), anti-CD28 antibody, CD40, CD37ligand (4-1BBL), IL-6, IL-15, IL-21, IFN-γ, IFN-α, IFN-β, CD27 ligand, CD30 ligand, IL-23, IL-1α and IL-1β.

One or more T cell stimulatory molecules may be added together with or coupled to MHC multimer and/or antigenic peptide. Likewise other adjuvants or molecules enhancing or otherwise affecting the cellular, humoral or innate immune response may be coupled to or added.

The number of antigen-specific cytotoxic T cells can be used as surrogate markers for the overall wellness of the immune system. The immune system can be compromised severely by natural causes such as HIV infections or big traumas or by immuno suppressive therapy in relation to transplantation.

MHC multimers and/or antigenic peptide can be of importance in diagnosis of infections caused by bacteria, especially those hiding inside cells. Clinical symptoms of a chronic infection can be unrecognizable in otherwise healthy individuals, even though such persons still are disease-carriers and at risk of becoming spontaneously ill if being compromised by other diseases or stress. In some acute infections the clinical symptoms are similar to clinical symptoms of completely unrelated diseases and therefore diagnosis of the disease is difficult based on clinical symptoms alone. Many infectious agents can be detected directly e.g. by measurement in serum. However, serum titres of the infectious agent can for other infectious agents be very low and therefore hard to measure. For intracellular pathogens direct measurement of the disease-causing organisms by e.g. PCR can be very difficult because the host cells are not identified or are inaccessible. Instead of detecting the infectious agent directly the immune response elicited by the infections agent may be measured.

Infections caused by extracellular bacteria and parasites often mediate a humoral immune response that can be monitored by measuring the specific antibody response.

An alternative to measure antibodies could be measurement of CD4+ T cells which are important for establishing a humoral response. Likewise infections caused by intracellular bacteria can be detected by measurement of CD8+ T cells specific for the infectious agent.

An example of an infectious disease where MHC multimers and/or antigenic peptides are useful is in diagnosis of Borreliosis also called Lyme disease caused by *Borrelia* bacteria. *Borrelia* bacteria are very difficult to detect directly due to low serum titres and their ability to stay inside cells of unknown origin. Clinical symptoms caused by infection with *Borrelia* bacteria depend on the type of bacteria and are similar to clinical symptoms of other diseases. *Borrelia* specific CD4+ and CD8+ T cells can be measured in serum, cerebrospinal fluid and/or joint fluid from infected individuals. The presence of a *Borrelia* infection can be measured using MHC multimers able to detect *Borrelia* specific T cells in liquid samples, preferably blood, from patients suspected of having borreliosis.

Such MHC multimers may be added directly to sample or alternatively antigenic peptides may be added to sample and then cell-based MHC multimer generated in sample as described elsewhere herein.

MHC multimers can in principle be applied to diagnosis of any infection caused by an infectious agent eliciting a cellular immune response by measurement of antigen-specific T cells or changes in the amount antigen-specific T cells in the circulation.

Antigen-specific T helper cells and regulatory T cells have been implicated in the development of autoimmune disorders. In most cases the timing of events leading to autoimmune disease is unknown and the exact role of the immune cells not clear. Use of MHC multimers to study these diseases will lead to greater understanding of the disease-causing scenario and make provisions for development of therapies and vaccines for these diseases.

Therapeutic use of MHC multimers and/or antigenic peptide is possible, either directly or as part of therapeutic vaccines. In therapies involving T cells, e.g. treatment with in vitro amplified antigen-specific effector T cells, the T cells often do not home effectively to the correct target sites but ends up in undesired parts of the body. If the molecules responsible for interaction with the correct homing receptor can be identified these can be added to the MHC multimer making a dual, triple or multiple molecular structure that are able to aid the antigen-specific T cells home to the correct target, as the MHC multimer will bind to the specific T cell and the additional molecules will mediate binding to the target cells.

In a preferable embodiment, MHC multimers bound to other functional molecules are employed to directly block, regulate or kill the targeted cells.

In a preferable embodiment, MHC multimers bound to other functional molecules are employed to directly block, regulate or kill these cells.

In another aspect of the present disclosure modulation of regulatory T cells could be part of a treatment. In diseases where the function of regulatory T cells is understood it may be possible to directly block, regulate or kill these regulatory cells by means of MHC multimers that besides MHC-peptide complexes also features other functional molecules. The MHC multimers specifically recognize the target regulatory T cells and direct the action of the other functional molecules to this target T cell.

Diseases

MHC multimers and/or antigenic peptides can be used in immune monitoring, diagnostics, prognostics, therapy and vaccines for diseases caused by *Borrelia* bacteria, including but not limited to infectious disease caused by *Borrelia burgdorferi, Borrelia Garinii, Borrelia Afzelii* and others disclosed herein elsewhere.

Approaches to the Analysis or Treatment of Diseases

For each application of a MHC multimer and/or antigenic peptide a number of choices must be made. These include:

A. Disease (to be e.g. treated, prevented, diagnosed, monitored); *Borrelia* infection B. Application (e.g. analyse by flow cytometry, isolate specific cells, induce an immune response)

C. Label (e.g. should the MHC multimer be labelled with a fluorophore or a chromophore)

D. Biologically active molecule (e.g. should a biologically active molecule such as an interleukin be added or chemically linked to the complex)

E. Peptide sequence (e.g. decide on the sequence of one or more antigenic peptide to be complexed with MHC or used as product itself)

F. MHC (e.g. use a MHC allele that does not interfere with the patient's immune system in an undesired way. This step is directly relevant for use of MHC multimers but also indirectly applicable when using antigenic peptides since these will following addition to assay/individual bind MHC molecules in sample/individual generating MHC multimer in sample/individual as described elsewhere herein).

A number of *Borrelia* infections $A_1$-$A_n$ relevant in connection with MHC multimers and antigenic peptides have been described herein, and includes in particular infection with *B. burgdorferi, B. afzelii* and/or *B. garinii*; A number of applications $B_1$-$B_n$, relevant in connection with MHC multimers and antigenic peptides have been described herein; a number of Labels $C_1$-$C_n$, relevant in connection with MHC multimers have been described herein; a number of biologically active molecules $D_1$-$D_n$, relevant in connection with MHC multimers and antigenic peptides have been described herein; a number of peptide sequences $E_1$-$E_n$, relevant in connection with MHC multimers and antigenic peptides have been described herein; and a number of MHC molecules $F_1$-$F_n$, relevant in connection with MHC multimers have been described herein.

Thus, each approach involves a choice to be made regarding all or some of the parameters A-F. A given application and the choices it involves can thus be described as follows:

$$Ai \times Bi \times Ci \times Di \times Ei \times Fi$$

where i specifies a number between 1 and n. n is different for different choices A, B, C, D, E, or F. Consequently, the present disclosure describes a large number of approaches to the diagnosis, monitoring, prognosis, therapeutic or vaccine treatment of disease. The total number of approaches, as defined by these parameters, are $$n(A) \times n(B) \times n(C) \times n(D) \times n(E) \times n(F),$$

where n(A) describes the number of different diseases A described herein, n(B) describes the number of different applications B described herein, etc.

Methods Involving Panels of MHC Multimers and Antigenic Peptides in *Borrelia*

The panels comprising one or more MHC multimers wherein each MHC multimer comprises an antigenic peptide P derived from a *Borrelia* antigenic polypeptide selected from the group consisting of OppA, DbpA, FlhF, FlaB and P37-42, and the panels comprising one or more pools of MHC multimers, wherein each pool comprises one or more MHC multimer each comprising an antigenic peptide P derived from a *Borrelia* antigenic polypeptide selected from the group consisting of OppA, DbpA, FlhF, FlaB and P37-42, can thus be employed in methods relevant for *Borrelia* including immune monitoring of *Borrelia* disease, diagnosing of *Borrelia* disease, isolation of *Borrelia* antigen-specific T cells and detection of *Borrelia* antigen-specific T cell responses.

It is therefore an aspect of the present disclosure to provide a method for immune monitoring of a *Borrelia* disease comprising one or more steps of:

i) providing a panel comprising one or more MHC multimers or providing a panel comprising one or more pools of MHC multimers wherein each pool comprises one or more MHC multimers, as disclosed herein elsewhere ii) providing a sample comprising a population of T cells, and iii) measuring the presence, frequency, number, activity and/or state of T cells specific for said panel comprising MHC multimers, thereby immune monitoring said *Borrelia* disease.

It is also an aspect of the present disclosure to provide a method for diagnosing a *Borrelia* disease comprising one or more steps of:

i) providing a panel comprising one or more MHC multimers or providing a panel comprising one or more pools of MHC multimers wherein each pool comprises one or more MHC multimers, as disclosed herein elsewhere ii) providing a sample comprising a population of T cells, iii) measuring the presence, frequency, number, activity and/or state of T cells specific for said panel comprising MHC multimers, thereby diagnosing said *Borrelia* disease.

In one embodiment said method for diagnosing a *Borrelia* disease further comprises one or more steps of treating said *Borrelia* disease.

In one embodiment said further steps of treating said *Borrelia* disease comprises administration of one or more antibiotics, such as one or more antibiotics selected from the group consisting of doxycycline, amoxicillin, cefuroxime axetil, azithromycin, ceftriaxone, and cefotaxime.

In one embodiment said *Borrelia* disease is a *Borrelia* infection.

In one embodiment said *Borrelia* disease is a *Borrelia* infection caused by a *Borrelia* species.

In one embodiment said *Borrelia* disease is selected from the group consisting of Lyme disease (Lyme borreliosis), Erythema migrans (EM), Borrelial lymphocytoma, Lyme neuroborreliosis (LB), Carditis, Lyme Arthritis (LA), Acrodermatitis chronica atrophicans (ACA).

It is also an aspect of the present disclosure to provide a method for isolation of one or more antigen-specific T cells, said method comprising one or more steps of
  i) providing a panel comprising one or more MHC multimers
  or
  providing a panel comprising one or more pools of MHC multimers wherein each pool comprises one or more MHC multimers,
  ii) providing a sample comprising a population of T cells,
  iii) contacting said panel with said sample comprising a population of T cells, and
  iv) isolating T cells specific for said panel comprising MHC multimers.

Detecting Response

It is also an aspect of the present disclosure to provide a method for detecting an antigen-specific T cell response comprising one or more steps of:
  i) providing a sample comprising a population of T cells,
  ii) providing a panel comprising one or more MHC multimers,
  or
    providing a panel comprising one or more pools of MHC multimers wherein each pool comprises one or more MHC multimers, as disclosed herein elsewhere,
  iii) contacting said panel with said sample, and
  iv) measuring the presence, frequency, number, activity and/or state of T cells specific for said panel comprising MHC multimers, thereby detecting said antigen-specific T cell response.

It is also an aspect of the present disclosure to provide a method for detecting an antigen-specific T cell response comprising one or more steps of:
  i) providing a sample comprising a population of T cells and a population of MHC expressing cells,
  ii) providing a panel comprising one or more antigenic peptides P each derived from a *Borrelia* antigenic polypeptide selected from the group consisting of OppA, DbpA, FlhF, FlaB and P37-42, or
    providing a panel comprising one or more pools of antigenic peptides P wherein each pool comprises one or more antigenic peptides P each derived from a *Borrelia* antigenic polypeptide selected from the group consisting of OppA, DbpA, FlhF, FlaB and P37-42,
  iii) contacting said sample with said panel, thereby allowing said antigenic peptides P and said MHC expressing cells to interact to provide MHC multimers, and
  iv) measuring the presence, frequency, number, activity and/or state of T cells specific for said panel comprising antigenic peptides P, thereby detecting said antigen-specific T cell response.

In one embodiment said sample comprising a population of T cells is a sample comprising T cells, monocytes and/or B cells.

In one embodiment said sample comprising a population of T cells is selected from a blood sample, a whole blood sample and a PBMC sample.

In one embodiment said sample comprising a population of MHC expressing cells comprises one or more of antigen presenting cells, dendritic cells, macrophages, Kupfer cells, Langerhans cells, monocytes and B-cells.

In one embodiment said sample comprising a population of MHC expressing cells comprise cells with a natural expression of MHC (i.e. not stimulated); and/or cells that needs to be induced/stimulated by e.g. Inf-γ to express MHC.

In one embodiment said sample comprising a population of MHC expressing cells comprise transfected cells expressing MHC and hybridoma cells expressing MHC.

In one embodiment said antigen-specific T cells are specific to a *Borrelia* antigenic polypeptide selected from the group consisting of OppA, DbpA, FlhF, FlaB and P37-42.

In one embodiment in step ii) said panel comprises one or more antigenic peptides P each derived from a *Borrelia* antigenic polypeptide selected from the group consisting of OppA (SEQ ID NOs:1-9), DbpA (SEQ ID NOs:10-20), FlhF (SEQ ID NOs:21-28), FlaB (SEQ ID NOs:29-37), and P37-42 (SEQ ID NOs:38-39).

In one embodiment in step ii) said panel comprises 1 antigenic peptide P, such as 2, for example 3, such as 4, for example 5, such as 6, for example 7, such as 8, for example 9, such as 10, for example 11, such as 12, for example 13, such as 14, for example 15, such as 16, for example 17, such as 18, for example 19, such as 20 antigenic peptides P each derived from a *Borrelia* antigenic polypeptide selected from the group consisting of OppA, DbpA, FlhF, FlaB and P37-42;
  such as an antigenic peptide P derived from a *Borrelia* antigenic polypeptide selected from the group consisting of OppA (SEQ ID NOs:1-9), DbpA (SEQ ID NOs:10-20), FlhF (SEQ ID NOs:21-28), FlaB (SEQ ID NOs:29-37), and P37-42 (SEQ ID NOs:38-39).

In one embodiment in step ii) said panel comprises
  i) one or more antigenic peptides P, such as 1 antigenic peptide P, such as 2, for example 3, such as 4, for example 5, such as 6, for example 7, such as 8, for example 9, such as 10 antigenic peptides P each derived from *Borrelia* antigenic polypeptide OppA,
  ii) one or more antigenic peptides P, such as 1 antigenic peptide P, such as 2, for example 3, such as 4, for example 5, such as 6, for example 7, such as 8, for example 9, such as 10 antigenic peptides P each derived from *Borrelia* antigenic polypeptide DbpA,
  iii) one or more antigenic peptides P, such as 1 antigenic peptide P, such as 2, for example 3, such as 4, for example 5, such as 6, for example 7, such as 8, for example 9, such as 10 antigenic peptides P each derived from *Borrelia* antigenic polypeptide FlhF,
  iv) one or more antigenic peptides P, such as 1 antigenic peptide P, such as 2, for example 3, such as 4, for example 5, such as 6, for example 7, such as 8, for example 9, such as 10 antigenic peptides P each derived from *Borrelia* antigenic polypeptide FlaB, and/or
  v) one or more antigenic peptides P, such as 1 antigenic peptide P, such as 2, for example 3, such as 4, for example 5, such as 6, for example 7, such as 8, for example 9, such as 10 antigenic peptides P each derived from *Borrelia* antigenic polypeptide P37-42.

In one embodiment in step ii) said panel comprises one or more antigenic peptides P derived from *Borrelia* antigenic polypeptides: OppA and DbpA; OppA and FlhF; OppA and FlaB; OppA and P37-42; DbpA and FlhF; DbpA and FlaB; DbpA and P37-42; FlhF and FlaB; FlhF and P37-42; or FlaB and P37-42.

In one embodiment in step ii) said panel comprises one or more antigenic peptides P derived from *Borrelia* antigenic polypeptides: OppA, DbpA and FlhF; OppA, DbpA and FlaB; OppA, DbpA and P37-42; OppA, FlhF and FlaB; OppA, FlhF and P37-42; OppA, FlaB and P37-42; DbpA, FlhF and FlaB; DbpA, FlhF and P37-42; or FlhF, FlaB and P37-42.

In one embodiment in step ii) said panel comprises one or more antigenic peptides P derived from *Borrelia* antigenic polypeptides: OppA, DbpA, FlhF and FlaB; OppA, DbpA, FlhF, P37-42; OppA, FlhF, FlaB and P37-42; OppA, DbpA, FlaB and P37-42; OppA, DbpA, FlhF and P37-42; DbpA, FlhF, FlaB and P37-42; or OppA, DbpA, FlhF, FlaB and P37-42.

In one embodiment in step ii) said panel comprises one or more antigenic peptides P each selected from the group consisting of:
i) antigenic peptides P derived from *Borrelia* antigenic polypeptide OppA (SEQ ID NOs:1-9) listed in Table A (Table A-1 to Table A-20),
ii) antigenic peptides P derived from *Borrelia* antigenic polypeptide DbpA (SEQ ID NOs:10-20) listed in Table B (Table B-1 to Table B-19),
iii) antigenic peptides P derived from *Borrelia* antigenic polypeptide FlhF (SEQ ID NOs:21-28) listed in Table C (Table C-1 to Table C-20),
iv) antigenic peptides P derived from *Borrelia* antigenic polypeptide FlaB (SEQ ID NOs:29-37) listed in Table D (Table D-1 to Table D-20), and/or
v) antigenic peptides P derived from *Borrelia* antigenic polypeptide P37-42 (SEQ ID NOS:38-39) listed in Table E (Table E-1 to Table E-20).

In one embodiment in step ii) said panel comprises one or more antigenic peptides P each selected from the group consisting of

YLNTKSNGNYEI, (SEQ ID NO: 359)

FLSIFTQGYT, (SEQ ID NO: 241)

GIYDLILNA, (SEQ ID NO: 2761)

YIKDINEFI, (SEQ ID NO: 4479)

IQIEIEQLTDEI, (SEQ ID NO: 5126)

RMISDQRANLGA, (SEQ ID NO: 5127)

SQGGVNSPV, (SEQ ID NO: 5112)

MLDEAKDKL, (SEQ ID NO: 5516)

FMEQATNSWI, (SEQ ID NO: 5530)

NLVFSSLFL, (SEQ ID NO: 5510)

or

KLAESIYKRL. (SEQ ID NO: 5531)

In one embodiment in step ii) each pool comprises one or more antigenic peptides P each derived from a *Borrelia* antigenic polypeptide selected from the group consisting of OppA (SEQ ID NOs:1-9), DbpA (SEQ ID NOs:10-20), FlhF (SEQ ID NOs:21-28), FlaB (SEQ ID NOs:29-37), and/or P37-42 (SEQ ID NOs:38-39).

In one embodiment in step ii) said panel comprises one or more pools of antigenic peptides P, wherein each pool comprises two or more antigenic peptides P, or
wherein in step ii) said panel comprises two or more pools of antigenic peptides P,
wherein each pool comprises one or more antigenic peptides P, or
wherein in step ii) said panel comprises two or more pools of antigenic peptides P,
wherein each pool comprises two or more antigenic peptides P;
wherein each antigenic peptide P is derived from a *Borrelia* antigenic polypeptide selected from the group consisting of OppA, DbpA, FlhF, FlaB and P37-42.

In one embodiment in step ii) said panel comprises one or more pools of antigenic peptides P, such as 1 pool, for example 2 pools, such as 3 pools, for example 4 pools, such as 5 pools, for example 6 pools, such as 7 pools, for example 8 pools, such as 9 pools, for example 10 pools of antigenic peptides P, wherein each pool comprises one or more antigenic peptides P, such as 1 antigenic peptide P, for example 2, such as 3, for example 4, such as 5, for example 6, such as 7, for example 8, such as 9, for example 10, for example 11, such as 12, for example 13, such as 14, for example 15, such as 16, for example 17, such as 18, for example 19, such as 20 antigenic peptides P.

In one embodiment in step ii) one or more pools comprises one or more antigenic peptides P each selected from the group consisting of:
i) antigenic peptides P derived from *Borrelia* antigenic polypeptide OppA (SEQ ID NOs:1-9) listed in Table A (Table A-1 to Table A-20),
ii) antigenic peptides P derived from *Borrelia* antigenic polypeptide DbpA (SEQ ID NOs:10-20) listed in Table B (Table B-1 to Table B-19),
iii) antigenic peptides P derived from *Borrelia* antigenic polypeptide FlhF (SEQ ID NOs:21-28) listed in Table C (Table β2C-1 to Table C-20),
iv) antigenic peptides P derived from *Borrelia* antigenic polypeptide FlaB (SEQ ID NOs:29-37) listed in Table D (Table D-1 to Table D-20), and/or
v) antigenic peptides P derived from *Borrelia* antigenic polypeptide P37-42 (SEQ ID NOS:38-39) listed in Table E (Table E-1 to Table E-20).

In one embodiment in step ii) one or more pools comprises one or more antigenic peptides P each selected from the group consisting of:
i) antigenic peptides P derived from *Borrelia* antigenic polypeptide OppA (SEQ ID NOs:1-9) listed in Table A (Table A-1 to Table A-20), and including at least one or both of YLNTKSNGNYEI (SEQ ID NO: 359) and FLSIFTQGYT (SEQ ID NO: 241);
ii) antigenic peptides P derived from *Borrelia* antigenic polypeptide DbpA (SEQ ID NOs:10-20) listed in Table B (Table B-1 to Table B-19), and including at least GIYDLILNA (SEQ ID NO: 2761);
iii) antigenic peptides P derived from *Borrelia* antigenic polypeptide FlhF (SEQ ID NOs:21-28) listed in Table C (Table C-1 to Table C-20), and including at least YIKDINEFI (SEQ ID NO: 4479);
iv) antigenic peptides P derived from *Borrelia* antigenic polypeptide FlaB (SEQ ID NOs:29-37) listed in Table D (Table D-1 to Table D-20), and including at least one or more of IQIEIEQLTDEI (SEQ ID NO: 5126), RMISDQRANLGA (SEQ ID NO: 5127), and SQGGVNSPV (SEQ ID NO: 5112); and/or
v) antigenic peptides P derived from *Borrelia* antigenic polypeptide P37-42 (SEQ ID NOS:38-39) listed in Table E (Table E-1 to Table E-20) and including at least one or more of MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

In one embodiment in step ii) one or more pools comprises one or more antigenic peptides P each derived from *Borrelia* antigenic polypeptides: OppA and DbpA; OppA and FlhF; OppA and FlaB; OppA and P37-42; DbpA and FlhF; DbpA and FlaB; DbpA and P37-42; FlhF and FlaB; FlhF and P37-42; or FlaB and P37-42.

In one embodiment in step ii) one or more pools comprises one or more antigenic peptides P each derived from *Borrelia* antigenic polypeptides: OppA, DbpA and FlhF; OppA, DbpA and FlaB; OppA, DbpA and P37-42; OppA, FlhF and FlaB; OppA, FlhF and P37-42; OppA, FlaB and P37-42; DbpA, FlhF and FlaB; DbpA, FlhF and P37-42; or FlhF, FlaB and P37-42.

In one embodiment in step ii) one or more pools comprises one or more antigenic peptides P each derived from *Borrelia* antigenic polypeptides: OppA, DbpA, FlhF and FlaB; OppA, DbpA, FlhF, P37-42; OppA, FlhF, FlaB and P37-42; OppA, DbpA, FlaB and P37-42; OppA, DbpA, FlhF and P37-42; DbpA, FlhF, FlaB and P37-42; or OppA, DbpA, FlhF, FlaB and P37-42.

In one embodiment in step ii) one or more pools comprises one or more antigenic peptides P each selected from the group consisting of
i) YLNTKSNGNYEI (SEQ ID NO: 359), FLSIFTQGYT (SEQ ID NO: 241), GIYDLILNA (SEQ ID NO: 2761) and YIKDINEFI (SEQ ID NO: 4479),
ii) IQIEIEQLTDEI (SEQ ID NO: 5126), RMISDQRANLGA (SEQ ID NO: 5127) and SQGGVNSPV (SEQ ID NO: 5112), and/or
iii) IQIEIEQLTDEI (SEQ ID NO: 5126), MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

In one embodiment in step ii) one or more pools comprises one or more antigenic peptides P each selected from the group consisting of YLNTKSNGNYEI (SEQ ID NO: 359), FLSIFTQGYT (SEQ ID NO: 241), GIYDLILNA (SEQ ID NO: 2761), YIKDINEFI (SEQ ID NO: 4479), IQIEIEQLTDEI (SEQ ID NO: 5126), RMISDQRANLGA (SEQ ID NO: 5127) and SQGGVNSPV (SEQ ID NO: 5112), IQIEIEQLTDEI (SEQ ID NO: 5126), MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

In one embodiment in step ii) there is provided a panel comprising 3 pools of antigenic peptides P wherein
i) Pool 1 comprises YLNTKSNGNYEI (SEQ ID NO: 359), FLSIFTQGYT (SEQ ID NO: 241), GIYDLILNA (SEQ ID NO: 2761), and YIKDINEFI (SEQ ID NO: 4479),
ii) Pool 2 comprises IQIEIEQLTDEI (SEQ ID NO: 5126), RMISDQRANLGA (SEQ ID NO: 5127) and SQGGVNSPV (SEQ ID NO: 5112), and
iii) Pool 3 comprises MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

In one embodiment in step ii) said panels further comprise one or more negative control peptides P and/or one or more positive control peptides P, such as negative control peptide ALIAPVHAV (SEQ ID NO: 5913) and/or one or more positive control peptides selected form the group consisting of NLVPMVATV (SEQ ID NO: 5914), GLCTLVAML (SEQ ID NO: 5915) and comprising GILGFVFTL (SEQ ID NO: 5916).

Detection Principles

Diagnostic procedures, immune monitoring and some therapeutic processes of the present disclosure all involve identification and/or enumeration and/or isolation of antigen-specific T cells. Identification and enumeration of antigen-specific T cells may be done in a number of ways, and several assays are currently employed to provide this information.

In the following it is described how MHC multimers and/or antigenic peptides as described herein can be used to detect specific T cell receptors (TCRs) and thereby antigen-specific T cells in a variety of methods and assays. In the present disclosure detection includes detection of the presence of antigen-specific TCR/T cells in a sample, detection of and isolation of cells or entities with antigen-specific TCR from a sample and detection and enrichment of cells or entities with antigen-specific TCR in a sample.

The sample may be a biological sample including solid tissue, solid tissue section and fluid samples such as, but not limited to, whole blood, serum, plasma, nasal secretions, sputum, urine, sweat, saliva, transdermal exudates, pharyngeal exudates, bronchoalveolar lavage, tracheal aspirations, cerebrospinal fluid, synovial fluid, fluid from joints, vitreous fluid, vaginal or urethral secretions, semen, or the like. Herein, disaggregated cellular tissues such as, for example, hair, skin, synovial tissue, tissue biopsies and nail scrapings are also considered as biological samples.

Many of the assays and methods described in the present disclosure are particularly useful for assaying T-cells in blood samples. Blood samples includes but is not limited to whole blood samples or blood processed to remove erythrocytes and platelets (e.g., by Ficoll density centrifugation or other such methods known to one of skill in the art) and the remaining PBMC sample, which includes the T-cells of interest, as well as B-cells, macrophages and dendritic cells, is used directly. Also included are blood samples processed in other ways e.g. isolating various subsets of blood cells by selecting or deselecting cells or entities in blood.

In order to be able to detect specific T cells by MHC multimers, labels and marker molecules can be used.

Marker Molecules

Marker molecules are molecules or complexes of molecules that bind to other molecules. Marker molecules thus may bind to molecules on entities, including the desired entities as well as undesired entities. Labelling molecules are molecules that may be detected in a certain analysis, i.e. the labelling molecules provide a signal detectable by the used method. Marker molecules, linked to labelling molecules, constitute detection molecules. Likewise labelling molecules linked to MHC multimers also constitute detection molecules but in contrast to detection molecules made up of marker and labelling molecule labelled MHC multimers are specific for TCR. Sometimes a marker molecule in itself provides a detectable signal, wherefore attachment to a labelling molecule is not necessary.

Marker molecules are typically antibodies or antibody fragments but can also be aptamers, proteins, peptides, small organic molecules, natural compounds (e.g. steroids), non-peptide polymers, or any other molecules that specifically and efficiently bind to other molecules are also marker molecules.

Labelling Molecules

Labelling molecules are molecules that can be detected in a certain analysis, i.e. the labelling molecules provide a signal detectable by the used method. The amount of labelling molecules may in one embodiment be quantified.

The labelling molecule may be any labelling molecule suitable for direct or indirect detection. By the term "direct" is meant that the labelling molecule can be detected per se without the need for a secondary molecule, i.e. is a "primary" labelling molecule. By the term "indirect" is meant that the labelling molecule can be detected by using one or more "secondary" molecules, i.e. the detection is performed by the detection of the binding of the secondary molecule(s) to the primary molecule.

In one embodiment the labelling molecule is attached to the multimerization domain. In one embodiment the labelling molecule is attached to the MHC molecule.

The labelling molecule may further be attached via a suitable linker. Linkers suitable for attachment to labelling molecules would be readily known by the person skilled in the art and as described elsewhere herein for attachment of MHC molecules to multimerization domains.

Examples of such suitable labelling compounds are polymers, nucleic acids, oligonucleotides, peptides, fluorescent labels, phosphorescent labels, enzyme labels, chemiluminescent labels, bioluminescent labels, haptens, antibodies, dyes, nanoparticle labels, elements, metal particles, heavy metal labels, isotope labels, radioisotopes, stable isotopes, chains of isotopes and single atoms.

Labels may be organic or inorganic molecules or particles.

Organic molecules labels include ribonucleic acids (e.g. RNA, DNA or unnatural DNA, RNA, and XNA (e.g. PNA, LNA, GNA, TNA) and mononucleotides, peptides and other polyamides (e.g. peptides comprising β-amino acid residues), lipids, carbohydrates, amino acids, and many other molecules.

Inorganic molecule labels include the elements (e.g. Lanthanum, Cerium, Praseodymium, Neodymium, Promethium, Samarium, Europium, Gadolinium, Terbium, Dysprosium, and the rest of the elements known). The elements may be coupled to the linker by way of chelates that coordinate the ions (interact non-covalently with the ions), where the chelates are then linked to the linker (in cases such as Gadolinium where the element can exist on ionic form), or the element may be contained in micelles. For some applications, rare elements are particularly favourable. For other applications heavy metals are particularly favourable.

A molecule label may have a molecular weight of between 1 Da and several million Da. In some instances a very low molecular weight is preferred, such as a molecular weight of 1-10 Da, 11-50 Da, 50-250 Da, or 251-500 Da. This may for example be the case when mass spectrometry is used to detect the identity of element labels (e.g. Gadolinium, Gd). In other cases a low molecular weight, e.g. 501-2000 Da, 2001-5000 Da, or 5001-10000 Da may be preferred. This may be the case when e.g. peptide labels are used, where the peptide label comprises around 10-40 amino acid residues. In yet other cases, a high molecular weight of the molecule label is practical, and the molecular weight of the molecule label may be 10001-50000 Da, 50001-200000 Da, or 200000-1000000 Da. This may be the case e.g. in cases where a ribonucleic acid label is used, where the coding region (also called the barcode region or barcode sequence) is of significant length (e.g. 10-20 nucleotides) and where it is practical to have flanking primer binding regions of each 10-20 nucleotides, plus other sequences of different practical use. The resulting oligonucleotide label may in these cases be 30-1000 nt long, corresponding to molecular weights of about 10000-600000 Da. Finally, multi-molecule structures, such as in cases where a number of different fluorescent proteins are ordered in an array by binding to specific regions in a template DNA, where the total label thus comprises a long oligonucleotide to which is bound a number of proteins, and the total molecular weight of the label may thus be 50000-200000 Da, 200001-100000, or 1000001-10000000 Da.

In one embodiment the labels are fluorophores and other molecules that emit or absorb radiation. The fluorophores and other molecules emitting or absorbing radiation may be of organic or inorganic nature, and can be e.g. small molecules as well as large proteins. In one embodiment, it is particularly favourable if all the fluorophores and other molecules that emit or absorb radiation are within the same narrow range of emission wavelength optimum, such as having wavelength optima in the range 1-10 nm, 11-30 nm, 31-100 nm, 101-200 nm, 201-300 nm, 301-400 nm, 401-500 nm, 501-600 nm, 601-700 nm, 701-800 nm, 800-900 nm, 901-1200 nm, 1201-1500 nm, or larger than 1500 nm. As an example, if the instrument has a narrow range of wavelengths that can be detected, it is advantageous that all labels fall within this range of detection. On the other hand, if the instrument used to detect the radiation emitted by the labels has a wide span of detectable wavelengths, it is desirable that the different labels used in an experiment fall in several of the above-mentioned ranges, as this will result in little overlap between emission of different labels, and therefore more accurate detection of relative abundance of the different labels of an experiment. Emitted radiation may be phosphorescence, luminescence, fluorescence and more.

The labelling compound may suitably be selected:

from fluorescent labels such as 5-(and 6)-carboxyfluorescein, 5- or 6-carboxyfluorescein, 6-(fluorescein)-5-(and 6)-carboxamido hexanoic acid, fluorescein isothiocyanate (FITC), rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, Green fluorescent protein (GFP) and analogues thereof, and conjugates of R-phycoerythrin or allophycoerythrin and e.g. Cy5 or Texas Red, and inorganic fluorescent labels based on semiconductor nanocrystals (like quantum dot and Qdot™ nanocrystals), and time-resolved fluorescent labels based on lanthanides like Eu3+ and Sm3+, from haptens such as DNP, biotin, and digoxigenin, from enzymatic labels such as horse radish peroxidase (HRP), alkaline phosphatase (AP), beta-galactosidase (GAL), glucose-6-phosphate dehydrogenase, beta-N- acetyl-glucosaminidase, ß-glucuronidase, invertase, Xanthine Oxidase, firefly luciferase and glucose oxidase (GO), from luminescence labels such as luminol, isoluminol, acridinium esters, 1,2-dioxetanes and pyridopyridazines, from radioactivity labels such as incorporated isotopes of iodide, cobalt, selenium, tritium, and phosphor, and from single atoms such as zinc (Zn), iron (Fe), magnesium (Mg), any of the lanthanides (Ln) including La, Ce, Pr, Nd, Pm, Sm, Eu, Gd, Tb, Dy, Ho, Er, Tm, Yb and Lu; scandium (Sc) and yttrium (Y).

Radioactive labels may in particular be interesting in connection with labelling of the peptides harboured by the MHC multimers.

Different principles of labelling and detection exist, based on the specific property of the labelling molecule. Examples of different types of labelling are emission of radioactive radiation (radionuclide, isotopes), absorption of light (e.g. dyes, chromophores), emission of light after excitation (fluorescence from fluorochromes), NMR (nuclear magnetic resonance form paramagnetic molecules) and reflection of light (scatter from e.g. such as gold-, plastic- or glass-beads/particles of various sizes and shapes). Alternatively, the labelling molecules can have an enzymatic activity, by which they catalyze a reaction between chemicals in the near environment of the labelling molecules, producing a signal, which include production of light (chemi-luminescence), precipitation of chromophor dyes, or precipitates that can be detected by an additional layer of detection molecules. The enzymatic product can deposit at the location of the enzyme or, in a cell based analysis system, react with the membrane of the cell or diffuse into the cell to which it is attached. Examples of labelling molecules and associated detection principles are shown the table below:

| Examples of labelling molecules and associated detection principles | | |
|---|---|---|
| Labelling substance | Effect | Assay-principle |
| Fluorochromes | emission of light having a specific spectra | ▫Photometry, Microscopy, spectroscopy PMT, photographic film, CCD's (Color-Capture Device or Charge-coupled device). |
| Radionuclide | irradiation, α, β or gamma ▫rays | Scintillation counting, GM-tube, photographic film, excitation of phosphor-imager screen |
| Enzyme; HRP, (horse reddish peroxidase), peroxidases in general | catalysis of $H_2O_2$ reduction using luminol as Oxygen acceptor, resulting in oxidized luminal + light catalysis of $H_2O_2$ reduction using a soluble dye, or molecule containing a hapten, such as a biotin residue as Oxygen acceptor, resulting in precipitation. The habten can be recognized by a detection molecule. | ▫Photometry, Microscopy, spectroscopy PMT, photographic film, CCD's (Colour-Capture Device or Charge-coupled device), Secondary label linked antibody |
| Particles; gold, polystyrene beads, pollen and other particles | Change of scatter, reflection and transparency of the associated entity | Microscopy, cytometry, electron microscopy PMT's, light detecting devices, flowcytometry scatter |
| AP (Alkaline Phosphatase) | Catalyze a chemical conversion of a non-detectable to a precipitated detectable molecule, such as a dye or a hapten | ▫Photometry, Microscopy, spectroscopy Secondary label linked antibody |
| Ionophores or chelating chemical compounds binding to specific ions, e.g. $Ca^{2+}$ | Change in absorption and emission spectrums when binding. Change in intensity | ▫Photometry, Cytometry, spectroscopy |
| Lanthanides | Fluorescence Phosphorescence Paramagnetic | ▫photometry, cytometry, spectroscopy NMR (Nuclear magnetic resonance) |
| DNA fluorescing stains | Propidium iodide Hoechst stain DAPI AMC DraQ5 ™ Acridine orange 7-AAD | ▫Photometry, cytometry, spectroscopy |
| Oligonucleotide tag/identifier | Unique sequence | PCR amplification, sequencing |

▫Photometry; is to be understood as any method that can be applied to detect the intensity, analyse the wavelength spectra, and or measure the accumulation of light derived form a source emitting light of one or multiple wavelength or spectra.

Labelling molecules can be used to label MHC multimers as well as other reagents used together with MHC multimers, e.g. antibodies, aptamers or other proteins or molecules able to bind specific structures in another protein, in sugars, in DNA or in other molecules. In the following molecules able to bind a specific structure in another molecule are named a marker.

Labelling molecules can be attached to a given MHC multimer or any other protein marker by covalent linkage as described for attachment of MHC multimers to multimerization domains elsewhere herein. The attachment can be directly between reactive groups in the labelling molecule and reactive groups in the marker molecule or the attachment can be through a linker covalently attached to labelling molecule and marker, both as described elsewhere herein. When labelling MHC multimers the label can be attached either to the MHC complex (heavy chain, β2m or peptide) or to the multimerization domain.

In particular,
one or more labelling molecules may be attached to the carrier molecule, or
one or more labelling molecules may be attached to one or more of the scaffolds, or one or more labelling compounds may be attached to one or more of the MHC complexes, or one or more labelling compounds may be attached to the carrier molecule and/or one or more of the scaffolds and/or one or more of the MHC complexes, or one or more labelling compounds may be attached to the peptide harboured by the MHC molecule.

A single labelling molecule on a marker does not always generate sufficient signal intensity. The signal intensity can be improved by assembling single label molecules into large multi-labelling compounds, containing two or more label molecule residues. Generation of multi-label compounds can be achieved by covalent or non-covalent, association of labelling molecules with a major structural molecule. Examples of such structures are synthetic or natural polymers (e.g. dextramers), proteins (e.g. streptavidin), or polymers. The labelling molecules in a multi-labelling compound can all be of the same type or can be a mixture of different labelling molecules.

In some applications, it may be advantageous to apply different MHC complexes, either as a combination or in individual steps. Such different MHC multimers can be differently labelled (i.e. by labelling with different labelling compounds) enabling visualisation of different target MHC-peptide recognising cells. Thus, if several different MHC multimers with different labelling compounds are present, it is possible simultaneously to identify more than one specific receptor, if each of the MHC multimers presents a different peptide.

Detection principles can be applied to flow cytometry, stationary cytometry, and batch-based analysis. Most batch-based approaches can use any of the labelling substances depending on the purpose of the assay. Flow cytometry primarily employs fluorescence, whereas stationary cytometry primarily employs light absorption, e.g. dyes or chromophore deposit from enzymatic activity. In the following section, principles involving fluorescence detection will be exemplified for flow cytometry, and principles involving chromophore detection will be exemplified in the context of stationary cytometry. However, the labelling molecules can be applied to any of the analyses described in this disclosure.

Labelling Molecules of Particular Utility in Flow Cytometry

In flow cytometry the typical label is detected by its fluorescence. Most often a positive detection is based on the presents of light from a single fluorochrome, but in other techniques the signal is detected by a shift in wavelength of emitted light; as in FRET based techniques, where the exited fluorochrome transfer its energy to an adjacent bound fluorochrome that emits light, or when using $Ca^{2+}$ chelating fluorescent props, which change the emission (and absorption) spectra upon binding to calcium. Preferable labelling molecules employed in flow cytometry are illustrated in Tables herein and described in the following:

Simple Fluorescent Labels:
Fluor dyes, Pacific Blue™, Pacific Orange™, Cascade Yellow™,
AlexaFluor®(AF);
AF405, AF488, AF500, AF514, AF532, AF546, AF555, AF568, AF594, AF610, AF633, AF635, AF647, AF680, AF700, AF710, AF750, AF800
Quantum Dot based dyes, QDot® Nanocrystals (Invitrogen, MolecularProbs)
Qdot®525, Qdot®565, Qdot®585, Qdot®605, Qdot®655, Qdot®705, Qdot®800
DyLight™ Dyes (Pierce) (DL);
DL549, DL649, DL680, DL800
Fluorescein (Flu) or any derivate of that, ex. FITC
Cy-Dyes
Cy2, Cy3, Cy3.5, Cy5, Cy5.5, Cy7
Fluorescent Proteins;
RPE, PerCp, APC
Green fluorescent proteins;
GFP and GFP-derived mutant proteins; BFP, CFP, YFP, DsRed, T1, Dimer2, mRFP1, MBanana, mOrange, dTomato, tdTomato, mTangerine, mStrawberry, mCherry
Tandem dyes:
RPE-Cy5, RPE-Cy5.5, RPE-Cy7, RPE-AlexaFluor® tandem conjugates; RPE-Alexa610, RPE-TxRed
APC-Aleca600, APC-Alexa610, APC-Alexa750, APC-Cy5, APC-Cy5.5
Ionophors; ion chelating fluorescent props
Props that change wavelength when binding a specific ion, such as Calcium
Props that change intensity when binding to a specific ion, such as Calcium
Combinations of fluorochromes on the same marker. Thus, the marker is not identified by a single fluorochrome but by a code of identification being a specific combination of fluorochromes, as well as inter related ratio of intensities.
Example: Antibody Ab1 and Ab2, are conjugated to both. FITC and BP but Ab1 have 1 FITC to 1 BP whereas Ab2 have 2 FITC to 1 BP. Each antibody may then be identified individually by the relative intensity of each fluorochrome. Any such combinations of n fluorochromes with m different ratios can be generated.

| Examples of preferred fluorochromes | | |
|---|---|---|
| Fluorofor/Fluorochrome | Excitation nm | Emission nm |
| 2-(4'-maleimidylanilino)naphthalene-6-sulfonic acid, sodium salt | 322 | 417 |
| 5-((((2-iodoacetyl)amino)ethyl)amino) naphthalene-1-sulfonic acid | 336 | 490 |
| Pyrene-1-butanoic acid | 340 | 376 |
| AlexaFluor 350 (7-amino-6-sulfonic acid-4-methyl coumarin-3-acetic acid) | 346 | 442 |
| AMCA (7-amino-4-methyl coumarin-3-acetic acid) | 353 | 442 |

Examples of preferred fluorochromes

| Fluorofor/Fluorochrome | Excitation nm | Emission nm |
|---|---|---|
| 7-hydroxy-4-methyl coumarin-3-acetic acid | 360 | 455 |
| Marina Blue (6,8-difluoro-7-hydroxy-4-methyl coumarin-3-acetic acid) | 362 | 459 |
| 7-dimethylamino-coumarin-4-acetic acid | 370 | 459 |
| Fluorescamin-N-butyl amine adduct | 380 | 464 |
| 7-hydroxy-coumarine-3-carboxylic acid | 386 | 448 |
| CascadeBlue (pyrene-trisulphonic acid acetyl azide) | 396 | 410 |
| Cascade Yellow | 409 | 558 |
| Pacific Blue (6,8 difluoro-7-hydroxy coumarin-3-carboxylic acid) | 416 | 451 |
| 7-diethylamino-coumarin-3-carboxylic acid | 420 | 468 |
| N-(((4-azidobenzoyl)amino)ethyl)-4-amino-3,6-disulfo-1,8-naphthalimide, dipotassium salt | 426 | 534 |
| Alexa Fluor 430 | 434 | 539 |
| 3-perylenedodecanoic acid | 440 | 448 |
| 8-hydroxypyrene-1,3,6-trisulfonic acid, trisodium salt | 454 | 511 |
| 12-(N-(7-nitrobenz-2-oxa-1,3-diazol-4-yl)amino)dodecanoic acid | 467 | 536 |
| N, N'-dimethyl-N-(iodoacetyl)-N'-(7-nitrobenz-2-oxa-1,3-diazol-4-yl)ethylenediamine | 478 | 541 |
| Oregon Green 488 (difluoro carboxy fluorescein) | 488 | 518 |
| 5-iodoacetamidofluorescein | 492 | 515 |
| Propidium iodide-DNA adduct | 493 | 636 |
| Carboxy fluorescein | 495 | 519 |

Examples of preferres fluorochrome families

| Fluorochrome family | Example fluorochrome |
|---|---|
| AlexaFluor ®(AF) | AF ®350, AF405, AF430, AF488,AF500, AF514, AF532, AF546, AF555, AF568, AF594, AF610, AF633, AF635, AF647, AF680, AF700, AF710, AF750, AF800 |
| Quantum Dot (Qdot ®) based dyes | Qdot ®525, Qdot ®565, Qdot ®585, Qdot ®605, Qdot ®655, Qdot ®705, Qdot ®800 |
| DyLight ™ Dyes (DL) | DL549, DL649, DL680, DL800 |
| Small fluorescing dyes | FITC, Pacific Blue ™, Pacific Orange ™, Cascade Yellow ™, Marina blue ™, DSred, DSred-2, 7-AAD, TO-Pro-3, |
| Cy-Dyes | Cy2, Cy3, Cy3.5, Cy5, Cy5.5, Cy7 |
| Phycobili Proteins: | R-Phycoerythrin (RPE), PerCP, Allophycocyanin (APC), B-Phycoerythrin, C-Phycocyanin |
| Fluorescent Proteins | (E)GFP and GFP ((enhanced) green fluorescent protein) derived mutant proteins; BFP, CFP, YFP, DsRed, T1, Dimer2, mRFP1, MBanana, mOrange, dTomato, tdTomato, mTangerine, mStrawberry, mCherry |
| Tandem dyes with RPE | RPE-Cy5, RPE-Cy5.5, RPE-Cy7, RPE-AlexaFluor ® tandem conjugates; RPE-Alexa610, RPE-TxRed |
| Tandem dyes with APC | APC-Aleca600, APC-Alexa610, APC-Alexa750, APC-Cy5, APC-Cy5.5 |
| Calcium dyes | Indo-1-Ca2+ Indo-2-Ca2+ |

Preferred Labelling Molecules Employed in Stationary Cytometry and IHC

Enzymatic labelling, as exemplified in the below Table:

Horse radish peroxidase; reduces peroxides ($H_2O_2$), and the signal is generated by the Oxygen acceptor when being oxidized.

Precipitating dyes; Dyes that when they are reduced they are soluble, and precipitate when oxidized, generating a coloured deposit at the site of the reaction.

Precipitating agent, carrying a chemical residue, a hapten, for second layer binding of marker molecules, for amplification of the primary signal.

Luminol reaction, generating a light signal at the site of reaction.

Other enzymes, such as Alkaline Phosphatase, capable of converting a chemical compound from a non-detectable molecule to a precipitated detectable molecule, which can be coloured, or carries a hapten as described above.

Fluorescent labels, as exemplified in the above Tables; as those described for Flow cytometry are likewise important for used in stationary cytometry, such as in fluorescent microscopy.

Examples of preferred labels for stationary cytometry

| Label | Enzyme substrate, Oxygen acceptor Chromogen/ precipitating agent | Precipitate or Residue, hapten* for secondary detection layer | Binding partner to hapten |
|---|---|---|---|
| HRP | diaminobenzidine (DAB) | Colored precipitate | — |
| HRP | 3-amino-9-ethyl-carbazole (AEC+) | Colored precipitate | — |
| AP | Fast red dye | Red precipitate | — |
| HRP | biotinyl tyramide | Exposed Biotin residue | Streptavidin, avidine |
| HRP | fluorescein tyramide | Exposed Fluorescein residue | Anti-Fluorecein Antibody |
| "Enzyme" | Substrate that when reacted precipitate | Primary label, being a dye, chemiluminescence's, | Secondary label in case the primary |

| Examples of preferred labels for stationary cytometry | | | |
|---|---|---|---|
| Label | Enzyme substrate, Oxygen acceptor Chromogen/ precipitating agent | Precipitate or Residue, hapten* for secondary detection layer | Binding partner to hapten |
| | | or exposure of a hapten | label is a hapten |

In one embodiment the label comprises a connector molecule, which connector molecule is able to interact with a component on the multimerization domain and/or MHC molecule. In one embodiment the connector molecule is biotin or avidin. In one embodiment the multimerization domain comprises streptavidin to which the label binds via its biotin or avidin connector molecule.

Nucleic Acid Label

In one embodiment a MHC monomer or MHC multimer as defined herein comprises at least one nucleic acid label, such as a nucleotide label, for example an oligonucleotide label. Such nucleic acids labels are disclosed in WO 2015/188839 and WO 2015/185067.

In a particular embodiment the label is an oligonucleotide, such as a DNA oligonucleotide (DNA label).

The terms nucleic acid label, nucleic acid molecule, nucleotide label, oligonucleotide label, DNA molecule, DNA label, DNA tag, DNA oligonucleotides and nucleic acid component may be used interchangeably herein.

In one embodiment the nucleic acid label comprises one or more of the following components:
 barcode region,
 5' first primer region (forward)
 3' second primer region (reverse),
 random nucleotide region,
 connector molecule
 stability-increasing components
 short nucleotide linkers in between any of the above-mentioned components
 adaptors for sequencing
 annealing region Preferably the nucleic acid label comprises at least a barcode region (i.e. barcode sequence). A barcode region comprises a sequence of consecutive nucleic acids.

A nucleic acid label of the present invention comprises a number of consecutive nucleic acids. The nucleic acid can be any type of nucleic acid or modifications thereof, naturally occurring or synthetically made (artificial nucleic acids).

In one embodiment the nucleic acid label comprises or consists of DNA.

In another embodiment the nucleic acid label comprises or consists of RNA.

In yet another embodiment the nucleic acid label comprises or consists of artificial nucleic acids or Xeno nucleic acid (XNA).

Artificial nucleic acid analogs have been designed and synthesized by chemists, and include peptide nucleic acid (PNA), morpholino- and locked nucleic acid (LNA), as well as glycol nucleic acid (GNA), threose nucleic acid (TNA), HNA and CeNA. Each of these is distinguished from naturally occurring DNA or RNA by changes to the backbone of the molecule.

In yet another embodiment the nucleic acid label comprises or consists of one or more of XNA, PNA, LNA, TNA, GNA, HNA and CeNA, In a further embodiment the at least one nucleic acid molecule comprises or consists of DNA, RNA, and/or artificial nucleotides such as PLA or LNA. Preferably DNA, but other nucleotides may be included to e.g. increase stability.

In a particular embodiment the oligonucleotide used in the invention is a natural oligonucleotide such as DNA or RNA, or it may be PNA, LNA, or another type of unnatural oligonucleotide. The oligonucleotides may be modified on the base entity, the sugar entity, or in the linker connecting the individual nucleotides.

The length of the nucleic acid molecule may also vary. Thus, in one embodiment the at least one nucleic acid molecule has a length in the range 20-100 nucleotides, such as 30-100, such as 30-80, such as 30-50 nucleotides.

In one embodiment the label is an oligonucleotide of length 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31-35, 36-50, 51-100, or more than 100 nucleotides.

In one embodiment the nucleic acid label comprises 1 to 1,000,000 nucleic acids, such as 1,2, 3,4,5,6,7,8, 9, 10, 11, 12, 13, 14, 15, 16, 17, 18, 19,20,21,22,23,24, 25, 26, 27, 28, 29, 30, 31, 32, 33, 34, 35, 36, 37, 38, 39, 40 nucleic acids; for example 1-3, 3-5, 5-10, 10-15, 15-20, 20-25, 25-30, 30-35, 35-40, 40-50, 50-60, 60-70, 70-80, 80-90, 90-100, 100-110, 110-120, 120-130, 130-140, 140-150, 150-175, 175-200, 200-250, 250-300, 300-400, 400-500, 500-600, 600-700, 700-800, 800-900, 900-1000, 1000-1500, 1500-2000, 2000-3000, 3000-4000, 4000-5000, 5000-7500, 7500-10,000, 10,000-100,000, 100,000-1,000,000 nucleic acids.

A nucleic acid label of the present invention as minimum comprises a number of consecutive nucleic acids. The sequence of the nucleic acids serves as a code that can be identified, such as amplified and/or sequenced.

The identifiable consecutive nucleic acids, or the identifiable sequence, of the nucleic acid label are denoted a 'barcode', 'barcode region', 'nucleic acid barcode', 'unique sequence', 'unique nucleotide sequence' and 'coding sequence' herein (used interchangably). The barcode region comprises of a number of consecutive nucleic acids making up a nucleic acid sequence.

In one embodiment the nucleic acid label comprises a central stretch of nucleic acids (barcode region) designed to be amplified by e.g. PCR.

In one embodiment, a nucleic acid barcode is a unique oligo-nucleotide sequence ranging for 10 to more than 50 nucleotides. In this embodiment, the barcode has shared amplification sequences in the 3' and 5' ends, and a unique sequence in the middle. This unique sequence can be revealed by sequencing and can serve as a specific barcode for a given MHC multimer.

The unique sequence, the barcode, is composed of a series of nucleotides that together forms a sequence (series of nucleotides) that can be specifically identified based on its composition. This sequence composition enables barcode #1 to be distinguishable from barcode #2, #3, #4 etc, up to more than 100.000 barcodes, based solely on the unique sequence of each barcode. The complete nucleotide barcode may also be composed of a combination of series of unique nucleotide sequences linked to each other. The series of unique sequences will together assign the barcode.

In one embodiment, each unique nucleotide sequence (barcode) holds 1, 2, 3, 4, 5, 6, 7,8, 9, 10, 11, 12, 13, 14, 15, 16, 17, 18, 19, 20, 21, 22, 23, 24, 25, 26, 27, 28, 29, 30, 31-35, 36-50, 51-100, or more than 100 nucleotides (nucleic acids).

In a preferred embodiment the label is an oligonucleotide, where the unique sequence has a length of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31-35, 36-50, 51-100, or more than 100 nucleotides. In one embodiment the unique sequence is shorter than the total length of the label.

In one embodiment the barcode region comprises or consists of 2-5, 5-10, 10-15, 15-20, 20-25, 25-30, 30-40, 40-45, 45-50, 50-60, 60-70, 70-80, 80-90, 90-100, 100-110, 110-120, 120-130, 130-140, 140-150, 150-175, 175-200, 200-250, 250-300, 300-400, 400-500 nucleic acids.

The unique nucleotide sequence (barcode) is solely used as an identification tag for the molecular interaction between the MHC molecule and its target. The unique nucleotide sequences preferably are not identical to any natural occurring DNA sequence, although sequence similarities or identities may occur.

Each nucleic acid barcode should hold sufficient difference from the additional barcodes in a given experiment to allow specific identification of a given barcode, distinguishable from the others.

The nucleic acid component (preferably DNA) has a special structure. Thus, in an embodiment the at least one nucleic acid molecule (label) is composed of at least a 5' first primer region, a central region (barcode region), and a 3' second primer region. In this way the central region (the barcode region) can be amplified by a primer set.

The coupling of the nucleic acid molecule to the multimerization domain may also vary. Thus, in one embodiment the at least one nucleic acid molecule is linked to said multimerization domain via a streptavidin-biotin binding and/or streptavidin-avidin binding. Other coupling moieties may also be used.

In one embodiment the nucleic acid label comprises a connector molecule, which connector molecule is able to interact with a component on multimerization domain or the MHC molecule. In one embodiment the connector molecule is biotin or avidin. In one embodiment the linker comprises streptavidin to which the label binds via its biotin or avidin connector molecule.

In one embodiment the nucleic acid label comprises a random nucleotide region. This random nt region is a potential tool for detecting label contaminants. A random nt region of the invention in one embodiment comprises from 3-20 nucleotides, such as 3, 4, 5, 6, 7, 8, 9, 10, 11, 12, 13,14,15, 16, 17, 18, 19 or 20 nt.

In some embodiments, the different labels used in an experiment possess the same amplification properties and share common primer regions: Common primer regions together with shared amplification properties will ensure that all labels that are present after cellular interaction and sorting are amplified equally whereby no sequences will be biased due to the sequencing reaction.

With identical primer regions on differing labels there is an inherent risk of contaminating one label with another—especially following amplification reactions. To be able to trace potential contaminants a short 'random nucleotide region' can be included in the nucleic acid label. Since the random nucleotide region is unique for each label, it will be possible to inspect the sequencing data and see whether numerous reads of a given label is present. I.e. the random nucleotide region is a clonality control region. In one embodiment the random nucleotide region consist of 2-20 nucleic acids; such as 2, 3, 4, 5, 6, 7, 8, 9, 10, 11, 12, 13, 14, 15, 16, 17, 18, 19 or 20 nucleic acids. A random nucleotide region consisting of 6 nucleotides may be denoted 'N6' herein, and so forth.

In one embodiment the nucleic acid label comprises one or more stability-increasing components (such as HEG or TEG)

The label is preferably stable when mixing with cells: as this may expose the label to nuclease digestion. A measure to minimize this may be to add modifications in the form of hexaethylene glycol (HEG) or TEG at one or both ends of the oligonucleotide label.

Additionally stability can be accounted for in the buffers applied by adding constituents that exert a protective effect towards the oligo-nucleotides, e.g herring DNA and EDTA In one embodiment the nucleic acid label comprises a sample identifying sequence. To be able to analyze more than a single sample in each sequencing reaction the nucleic acid labels may be appointed an additional recognition feature, namely a sample identifying sequence. The sample identifying sequence is not a part of the initial design of the label, but will be appointed after cellular interaction and sorting via primers in a PCR—thus all cells originating from the same sample, will have the same sample identification sequence. In one embodiment the sample identifying sequence is a short sequence, consisting of 2-20 nucleic acids; such as 2, 3, 4, 5, 6, 7, 8, 9, 10, 11, 12, 13, 14, 15, 16, 17, 18, 19 or 20 nucleic acids. The sample identifying sequence may be attached to a primer, such as the forward primer.

The nucleic acid label is in one embodiment a '1 oligo system' comprising a forward primer, a barcode region and a reverse primer.

The nucleic acid label is in one embodiment a '2 oligo system' with two sequences, the first comprising a forward primer, a barcode region and a annealing region; and the second comprising an annealing region, a barcode region and a reverse primer.

Peptide Label

In one embodiment the label is a peptide label comprising a stretch of consecutive amino acid residues. This is the 'coding region' the identity of which can be determined.

In one embodiment the peptide label comprises or consists of a defined number of consecutive amino acids. It follows that the nucleic acid label in one embodiment comprises 2 or more consecutive amino acids, such as 2-3, 3-4, 4-5, 5-6, 6-7, 7-8, 8-9, 9-10, 10-11, 11-12, 12-13, 13-14, 14-15, 15-16, 16-17, 17-18, 18-19, 19-20, 20-21, 21-22, 22-23, 23-24, 24-25, 25-26, 26-27, 27-28, 28-29, 29-30, 30-31, 31-32, 32-33, 33-34, 34-35, 35-36, 36-37, 37-38, 38-39, 39-40, 40-45, 45-50, 50-55, 55-60, 60-65, 65-70,70-75, 75-80, 80-85, 85-90, 90-95, 95-100, 100-110, 110-120, 120-130, 130-140, 140-150, 150-160, 160-170,170-180, 180-190, 190-200, 200-225, 225-250, 250-275, 275-300, 300-350, 350-400, 400-450, 450-500, 500-600, 600-700, 700-800, 800-900, 900-1000, 1000-1500, 1500-2000, or more than 2000, consecutive amino acids.

In one embodiment the peptide label comprises a stretch of consecutive amino acid residues (coding region) and a protease cleavage site. The protease cleavage site is preferably located proximal to the linker that connects the label to the MHC multimer.

When the MHC multimer is brought into proximity of a protease, the peptide label is cleaved and the coding region released from the MHC multimer. The sample cells may be precipitated and the supernatant can be analysed by mass spectrometry to determine the identity and amount of the labels that was released.

Proteases capable of cleaving the peptide labels may be coated on the surface of sample cells, for example by adding antibody-protease conjugates where the antibody recognizes a particular cell surface structure.

In one embodiment the peptide label comprises natural (or standard) amino acids. In another embodiment the peptide label comprises non-naturally occurring amino acids (non-proteinogenic or non-standard). In one embodiment the peptide label comprises standard and non-standard amino acids.

A natural amino acid is a naturally occurring amino acid existing in nature and being naturally incorporated into polypeptides (proteinogenic). They consist of the 20 genetically encoded amino acids Ala, Arg, Asn, Asp, Cys, Gln, Glu, Gly, His, Ile, Leu, Lys, Met, Phe, Pro, Ser, Tyr, Thr, Trp, Val, and 2 which are incorporated into proteins by unique synthetic mechanisms: Sec (selenocysteine, or U) and Pyl (pyrrolysine, O). These are all L-stereoisomers.

Aside from the 22 natural or standard amino acids, there are many other non-naturally occurring amino acids (non-proteinogenic or non-standard). They are either not found in proteins, or are not produced directly and in isolation by standard cellular machinery. Non-standard amino acids are usually formed through modifications to standard amino acids, such as post-translational modifications.

Any amino acids according to the present invention may be in the L- or D-configuration.

The standard and/or non-standard amino acids may be linked by peptide bonds to form a linear peptide chain.

The term peptide also embraces post-translational modifications introduced by chemical or enzyme-catalyzed reactions, as are known in the art. Also, functional equivalents may comprise chemical modifications such as ubiquitination, labeling (e.g., with radionuclides, various enzymes, etc.), pegylation (derivatization with polyethylene glycol), or by insertion (or substitution by chemical synthesis) of amino acids (amino acids) which do not normally occur in human proteins.

Protein post-translational modification (PTM) increases the functional diversity of the proteome by the covalent addition of functional groups or proteins, proteolytic cleavage of regulatory subunits or degradation of entire proteins. These modifications include phosphorylation, glycosylation, ubiquitination, nitrosylation, methylation, acetylation, lipidation (C-terminal glycosyl phosphatidylinositol (GPI) anchor, N-terminal myristoylation, S-myristoylation, S-prenylation), amidation, and proteolysis and influence almost all aspects of normal cell biology and pathogenesis.

Sterically similar compounds may be formulated to mimic the key portions of the peptide structure and that such compounds may also be used in the same manner as the peptides of the invention. This may be achieved by techniques of modelling and chemical designing known to those of skill in the art. For example, esterification and other alkylations may be employed to modify the amino terminus of e.g a di-arginine peptide backbone, to mimic a tetra peptide structure. It will be understood that all such sterically similar constructs fall within the scope of the present invention.

Peptides with N-terminal alkylations and C-terminal esterifications are also encompassed within the present invention. Functional equivalents also comprise glycosylated and covalent or aggregative conjugates formed with the same molecules, including dimers or unrelated chemical moieties. Such functional equivalents are prepared by linkage of functionalities to groups which are found in fragment including at any one or both of the N- and C-termini, by means known in the art.

Detection Methods and Principles

MHC multimers can be used to detect T-cell receptors (TCR) e.g. T-cells carrying specific TCR. For example, the MHC multimers can be labelled with fluorophores and used in flow cytometer, the MHC multimers can be labelled with chromophores, in order to specifically stain specific T-cells carrying TCRs that specifically bind the MHC multimer in question in e.g. sections of solid tissues using IHC.

ELISA and ELISA-like analyses can be performed with MHC multimers that are labelled with e.g. chromophores, fluorophores or enzymes.

MHC multimers can be used in a wide range of other methods using various principles. In the following methods and principles using MHC multimers for detection of TCR are outlined.

Detection of TCRs with MHC multimers may be direct or indirect.

Direct Detection

Direct detection of TCRs is detection directly of the binding interaction between the specific T cell receptor and the MHC multimer. The MHC multimer may be generated and then added to sample or alternatively MHC multimers are generated in sample by addition of antigenic peptide and MHC molecules attached to multimerization domain to sample.

Direct detection includes detection of TCR when TCR is attached to lipid bilayer (e.g. T cells), when TCR is attached to or in a solid medium or when TCR is in solution.

Direct Detection of TCR Attached to Lipid Bilayer

One type of TCRs to detect and measure are TCRs attached to lipid bilayer including but not limited to naturally occurring T cells (from blood, spleen, lymphnode, brain or any other tissue containing T cells), TCR transfected cells, T cell hybridomas, TCRs embedded in liposomes or any other membrane structure. In the following methods for direct detection of entities of TCRs attached to lipid bilayer will be described and any entity consisting of TCR attached to lipid bilayer will be referred to as T cells.

T cells can be directly detected either when in a fluid solution or when immobilized to a solid support.

Direct Detection of T Cells in Fluid Sample

T cells can be detected in fluid samples using the methods described below including but not limited to detection of T cells in culture media, in buffers, in water or in other liquids and also suspensions of disrupted tissues e.g. homogenized tissue resuspended in the fluids described above. T cells in fluid samples can be detected individually or detected as populations of T cells. In the following different methods for direct detection of T cells in fluid samples are described.

Direct Detection of Individual T Cells

Direct Detection of Individual T Cells Using Flow Cytometry

An example of direct detection of individual T cells by flow cytometry is measurement of antigen specific T cells using MHC multimers like Tetramers, Pentamers, Dextramers or similar types of reagents.

Briefly, a suspension of T cells are added MHC multimers, the sample washed and then the amount of MHC multimer bound to each cell are measured. Bound MHC multimers may be labelled directly or measured through addition and binding of labelled marker molecules. The sample is analysed using a flow cytometer, able to detect and count individual cells passing in a stream through a laser beam. For identification of specific T cells using MHC multimers, cells are stained with fluorescently labelled MHC multimer by incubating cells with fluorochrome labelled MHC multimer and then forcing the cells with a large volume of liquid through a nozzle creating a stream of spaced cells. Each cell passes through a laser beam and any fluorochrome bound to the cell is excited and thereby fluoresces. Sensitive photomultipliers detect emitted fluorescence, providing information about the amount of MHC multimer bound to the cell. By this method MHC multimers can be used to identify specific T cell populations in liquid samples such as blood, CSF, synovial fluid, cell cultures or any other liquid sample containing T cells.

When analysing blood samples whole blood can be used with or without lysis of red blood cells. Alternatively lymphocytes can be purified from blood before flow cytometry analysis e.g. using a standard procedure like a Ficoll-Hypaque gradient. Another possibility is to isolate lymphocytes, subgroups of lymphocytes, T cells or subgroups of T cells from the blood sample for example by affinity purification like binding to antibody coated surfaces, followed by elution of bound cells. This purified lymphocyte or T cell population can then be used for flow cytometry analysis together with MHC multimers. Instead of actively isolating T cells or subgroups of lymphocytes unwanted cells like B cells, NK cells or any other unwanted cells or substances can be removed prior to the analysis. One way to do this is by affinity purification e.g. using columns or beads or other surfaces coated with antibodies specific for the unwanted cells. Alternatively, specific antibodies recognizing the unwanted cells can be added to the blood sample together with complement proteins, thereby killing cells recognized by the antibodies. Various gating reagents can be included in the analysis. Gating reagents here means labelled antibodies or other labelled marker molecules identifying subsets of cells by binding to unique surface proteins. Preferred gating reagents when using MHC multimers are antibodies or other marker molecules directed against CD3, CD4, and CD8 identifying major subsets of T cells. Other preferred gating reagents are antibodies or marker molecules specifically binding CD14, CD15, CD19, CD25, CD56, CD27, CD28, CD45, CD45RA, CD45RO, CCR7, CCR5, CD62L, Foxp3, CD95, CD127, CD7, CD57, CD154 or other specific proteins or molecules unique for different lymphocytes of the immune system.

Following labelling with MHC multimers and before analysis on a flow cytometer stained cells can be treated with a fixation reagent e.g. formaldehyde to cross-link bound MHC multimer to the cell surface. Stained cells can also be analyzed directly without fixation.

The number of cells in a sample can vary. When the target cells are rare, it is preferable to analyze large amounts of cells. In contrast, fewer cells are required when looking at T cell lines or samples containing many cells of the target cell type.

The flow cytometer can be equipped to separate and collect particular types of cells. This is called cell sorting. MHC multimers in combination with sorting on a flow cytometer can be used to isolate specific T cell populations. Isolated specific T cell populations can then be further manipulated as described elsewhere herein, e.g. expanded in vitro. This can be useful in autologous cancer therapy.

Amounts of MHC-peptide specific T cells in a blood sample can be determined by flow cytometry by calculating the amount of MHC multimer labeled cells in a given volume of sample with a given cell density and then back calculate. Exact enumeration of specific T cells is better achieved by incubating sample with MHC multimers (and optionally gating reagents) together with an exact amount of counting beads followed by flow cytometry analysis. Counting beads is here to be understood as any fluorescent bead with a size that can be visualized in a sample containing T cells by flow cytometry. The beads could e.g. be made of polystyrene with a size of about 1-10 μm. They could also be made of agarose, polyacrylamide, silica, or any other material, and have any size between 0,1 m and 100 m. The counting beads are used as reference population to measure the exact volume of analyzed sample. The sample are analyzed on a flow cytometer and the amount of MHC-specific T cell detected can then be correlated with the amount of counting beads in the same volume of the sample and an exact number of MHC-peptide specific T cells determined using the following equation:

Concentration of MHC-specific T-cell in sample=
(number of MHC-peptide specific T cells counted/number of counting beads counted)× concentration of counting beads in sample Alternatively MHC multimers are added to one tube (below denoted tube 1) together with sample and counting beads are added to a separate tube (below denoted tube 2) containing the same sample but no MHC multimers. To both tubes one or more gating reagents are added able to identify other cell subsets in sample e.g. CD3+, CD4+, CD8+, CD19+, CD56+ cells. The exact amount of one of the cell subsets for which gating reagents are included are then calculated from the tube containing counting beads. For example if CD8+ cells are measured in both tubes the following equation can be used to determine the exact concentration of CD8+ cells in the sample:

(((number of CD8+ cells counted (tube 2))/(number of counting beads counted (tube 2)))×(concentration of counting beads in sample)=exact concentration of CD8+ cells in sample The exact concentration of CD8+ cells in sample are then used to determine the exact concentration of MHC-specific T cells in sample using the equation:

(Calculated exact concentration of CD8+ cells in sample (calculated from tube 2))×(MHC-specific T cells counted as percentage of CD8+ events counted in sample (tube 1))=concentration of MHC-specific T-cell in sample Direct Detection of Individual T Cells in Fluid Sample by Microscopy A suspension of T cells are added MHC multimers, the sample washed and then the amount of MHC multimer bound to each cell are measured. Bound MHC multimers may be labelled directly or labelled through addition of labelled marker molecules. The sample is then spread out on a slide or similar in a thin layer able to distinguish individual cells and labelled cells identified using a microscope. Depending on the type of label different types of microscopes may be used, e.g. if fluorescent labels are used a fluorescent microscope is used for the analysis. For example MHC multimers can be labeled with a fluorochrome or bound MHC multimer detected with a fluorescent antibody. Cells with bound fluorescent MHC multimers can then be visualized using an immunofluorescence microscope or a confocal fluorescence microscope.

Direct Detection of Populations of T Cells

Cell suspensions are added labeled MHC multimer, samples are washed and then total signal from label are measured. The MHC multimers may be labeled themselves or detected through a labeled marker molecule.

Cell suspensions are added labeled MHC multimer, samples are washed and then signal from label are amplified and then total signal from label and/or amplifier are measured.

Direct Detection of Immobilized T Cells

T cells may be immobilized and then detected directly. Immobilization can be on solid support, in solid tissue or in fixator (e.g. paraffin, a sugar matrix or another medium fixing the T cells).

Direct Detection of T Cells Immobilized on Solid Support

In a number of applications, it may be advantageous to immobilize the T cell onto a solid or semi-solid support. Such support may be any which is suited for immobilisation, separation etc. Non-limiting examples include particles, beads, biodegradable particles, sheets, gels, filters, membranes (e. g. nylon membranes), fibres, capillaries, needles, microtitre strips, tubes, plates or wells, combs, pipette tips, micro arrays, chips, slides, or indeed any solid surface material. The solid or semi-solid support may be labelled, if this is desired. The support may also have scattering properties or sizes, which enable discrimination among supports of the same nature, e.g. particles of different sizes or scattering properties, colour or intensities.

Conveniently the support may be made of glass, silica, latex, plastic or any polymeric material. The support may also be made from a biodegradable material.

Generally speaking, the nature of the support is not critical and a variety of materials may be used. The surface of support may be hydrophobic or hydrophilic.

Preferred are materials presenting a high surface area for binding of the T cells. Such supports may for example be porous or particulate e.g. particles, beads, fibres, webs, sinters or sieves. Particulate materials like particles and beads are generally preferred due to their greater binding capacity. Particularly polymeric beads and particles may be of interest.

Conveniently, a particulate support (e.g. beads or particles) may be substantially spherical. The size of the particulate support is not critical, but it may for example have a diameter of at least 1 μm and preferably at least 2 μm, and have a maximum diameter of preferably not more than 10 μm and more preferably not more than 6 μm. For example, particulate supports having diameters of 2.8 μm and 4.5 μm will work well.

An example of a particulate support is monodisperse particles, i.e. such which are substantially uniform in size (e. g. size having a diameter standard deviation of less than 5%). Such have the advantage that they provide very uniform reproducibility of reaction. Monodisperse particles, e.g. made of a polymeric material, produced by the technique described in U.S. Pat. No. 4,336,173 (ref. 25) are especially suitable.

Non-magnetic polymer beads may also be applicable. Such are available from a wide range of manufactures, e.g. Dynal Particles AS, Qiagen, Amersham Biosciences, Serotec, Seradyne, Merck, Nippon Paint, Chemagen, Promega, Prolabo, Polysciences, Agowa, and Bangs Laboratories.

Another example of a suitable support is magnetic beads or particles. The term "magnetic" as used everywhere herein is intended to mean that the support is capable of having a magnetic moment imparted to it when placed in a magnetic field, and thus is displaceable under the action of that magnetic field. In other words, a support comprising magnetic beads or particles may readily be removed by magnetic aggregation, which provides a quick, simple and efficient way of separating out the beads or particles from a solution. Magnetic beads and particles may suitably be paramagnetic or superparamagnetic. Superparamagnetic beads and particles are e.g. described in EP 0 106 873 (Sintef, ref. 26). Magnetic beads and particles are available from several manufacturers, e.g. Dynal Biotech ASA (Oslo, Norway, previously Dynal AS, e.g. Dynabeads®).

The support may suitably have a functionalised surface. Different types of functionalisation include making the surface of the support positively or negatively charged, or hydrophilic or hydrophobic. This applies in particular to beads and particles. Various methods therefore are e.g. described in U.S. Pat. No. 4,336,173 (ref. 25), U.S. Pat. No. 4,459,378 (ref. 27) and U.S. Pat. No. 4,654,267 (ref. 28).

Immobilized T cells may be detected in several ways including:

Direct Detection of T Cells Directly Immobilized on Solid Support.

T cells may be directly immobilized on solid support e.g. by non-specific adhesion. Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labelled cells, e.g. cells are immobilized in a monolayer on a cell culture well or a glass slide. Following staining with labelled multimer a digital picture is taken and labelled cells identified and counted.

Alternatively a population of T cells is detected by measurement of total signal from all labelled T cells, e.g. cells are plated to wells of a microtiter plate, stained with labelled MHC multimer and total signal from each well are measured.

Direct Detection of T Cells Immobilized on Solid Support Through Linker Molecule T cells can also be immobilized to solid support through a linker molecule. The linker molecule can be an antibody specific for the T cell, a MHC multimer, or any molecule capable of binding T cells. In any case the linker may be attached directly to the solid support, to the solid support through another linker, or the linker molecule may be embedded in a matrix, e.g. a sugar matrix.

Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labelled cells, e.g. a digital picture is taken and labelled cells identified and counted.

By using a specific MHC multimer both for the immobilization of the T-cells and for the labelling of immobilized cells (e.g. by labelling immobilized cells with chromophore- or fluorophore-labelled MHC multimer), a very high analytical specificity may be achieved because of the low background noise that results.

Alternatively a population of T cells is detected by measurement of total signal from all labeled T cells.

Immuno Profiling: Phenotyping T Cell Sample Using MHC Multimer Beads or Arrays.

Different MHC multimers are immobilized to different beads with different characteristics (e.g. different size, different fluorophores or different fluorescence intensities) where each kind of bead has a specific type of MHC multimer molecule immobilized. The immobilization may be direct or through a linker molecule as described above. The amount of bound T cells to a specific population of beads can be analyzed, thereby phenotyping the sample. The TCR on the T cell is defined by the MHC multimer and hence the bead to which it binds.

Likewise, MHC multimers can be immobilized in an array, e.g. on a glass plate or pin array so that the position in the array specifies the identity of the MHC multimer. Again, the immobilization may be direct or through a linker molecule as described above. After addition of T cells, the amount of bound T cells at a specified position in the array can be determined by addition of a label or labelled marker that binds to cells in general, or that binds specifically to the cells of interest. For example, the cells may be generally labelled by the addition of a labelled molecule that binds to all kinds of cells, or specific cell types, e.g. CD4+ T-cells, may be labelled with anti-CD4 antibodies that are labelled with e.g. a chromophore or fluorophore. Either of these approaches allow a phenotyping of the sample. An example for the use of immuno profiling is given below.

Profiling of an Individual's Disease-Specific T-Cell Repertoire.

Mass profiling of the T-cells of an individual may be done by first immobilizing specific MHC multimers (e.g. $10-10^6$ different MHC multimers, each comprising a specific MHC-peptide combination) in an array (e.g. a glass plate), adding e.g. a blood sample from the individual, and then after washing the unbound cells off, label the immobilized cells. Positions in the array of particularly high staining indicate MHC-peptide combinations that recognize specific T-cells of particularly high abundance or affinity. Thus, an immuno profiling of the individual with regard to the tested MHC-peptide combinations is achieved. A similar profiling of an individual's disease may be made using MHC multimers immobilized to different beads as described above.

Whether the profiling is performed using beads or arrays, the profiling may entail a number of diseases, a specific disease, a set of specific antigens implicated in one or more diseases, or a specific antigen (e.g. implicated in a specific disease or set of diseases).

In a preferred embodiment, an individual's immuno profile for a particular antigen is obtained. Thus, peptides corresponding to all possible 8'-, 9'-10'- and 11'-mer peptide sequences derived from the peptide antigen sequence are generated, for example by standard organic synthesis or combinatorial chemistry, and the corresponding MHC multimers are produced, using one or more of the class I MHC-alleles of the individual in question. Further, peptides of e.g. 13, 14, 15, 16 and up to 25 amino acids length may be generated, for example by organic synthesis or combinatorial chemistry, corresponding to all 13', 14', 15', 16' and up to 25'-mers of the antigen, and the corresponding class II MHC multimers are produced, using one or more of the class MHC-alleles of the individual in question. For a complete profiling for this particular antigen, all of the HLA-alleles of the individual in question should be used for the generation of the array; i.e., if the HLA class I haplotype of the individual is HLA-A*02, HLA-A*03, HLA-B*08 and HLA-B*07, all these HLA class I alleles should be combined with every tested peptide and similarly for all HLA class II alleles of the given individual. Based on the profile, a personalized drug, -vaccine or -diagnostic test may be produced.

The principle described above may also be employed to distinguish between the immune response raised against a disease (e.g. an infection with a bacterium or the formation of a tumour), and the immune response raised against a vaccine for the same disease (in the example, a vaccine against the bacterium or the tumour). Most vaccines consists of subcomponents of the pathogen/tumour they are directed against and/or are designed to elicit an immune response different from the natural occurring immune response i.e. the T cell epitopes of the two immune responses differs. Thus, by establishing the immuno profile, using a comprehensive array (i.e. an array that comprises all possible epitopes from one or more antigen(s)) or a subset of these epitopes, it is possible to deduce whether the immune response has been generated against the disease or the vaccine, or against both the disease and the vaccine. If the vaccine raises a response against a particular epitope or a particular set of epitopes, the corresponding positions in the array will give rise to high signals (compared to the remaining positions). Similarly a natural generated immune response will be directed against other and/or more particular epitopes and therefore give rise to high signals in other positions and/or more positions in the array. When an individual is vaccinated the immuno profile will reflect the effect of the vaccination on the immune response, and even if the individual has encountered the disease before and has generated a general immune response towards this disease, it will still be possible to deduce from the profiling whether this individual also has generated a specific response against the vaccine.

In another preferred embodiment, an individual's immuno profile for a set of antigens implicated in a specific disease is obtained. A subset of epitopes from a number of antigens is used. Thus, this is not a comprehensive profiling of this individual with regard to these antigens, but careful selection of the epitopes used may ensure that the profiling data can be used afterwards to choose between e.g. a limited set of vaccines available, or the data can be used to evaluate the immune response of the individual following an infection, where the epitopes used have been selected in order to avoid interference from related infectious diseases.

As above, a personalized drug, -vaccine or -diagnostic test may be produced based on the information obtained from the immuno profiling.

In yet another preferred embodiment, the array comprising all possible 8'-, 9'-10'- and 11'-mer peptide sequences derived from a given peptide antigen, and all 13, 14, 15 and 16'-mers of the same antigen, are synthesized and assembled in MHC multimers, and immobilized in an array. Then, the ability of the individual peptide to form a complex with MHC is tested. As an example, one may add labelled W6/32 antibody, an antibody that binds correctly folded MHC I heavy chain, when this heavy chain is assembled together with antigenic peptide and beta2microglobulin, and which therefore can be used to detect formation of MHC-peptide complex, as binding of W6/32 antibody is usually considered a strong indication that the MHC-peptide complex has been formed. The ability of different peptides to enter into a MHC-peptide complex may also be promoted by the addition to the array of T-cells. Specific T-cells will drive the formation of the corresponding specific MHC-peptide complexes. Thus, after addition of T-cells to the array, the MHC-peptide complex integrity can be examined by addition of the labelled W6/32 antibody or other antibodies specific for correct conformation. Positions on the array that have strong signals indicate that the peptide that was added to MHC and immobilized at this position, was capable of forming the MHC-peptide complex in the presence of specific T-cells. Alternatively, the binding of the specific T-cells to the corresponding MHC-peptide complexes may be detected directly through a labelled antibody specific for the T cell.

Direct Detection of Immobilized T Cells Followed by Sorting

Specific T cells or specific T cell subsets can be isolated from a sample containing other T cells, T cell subsets and/or other cells by immobilization of the wanted specific T cells in sample to solid support as described above followed by washing and elution. For example, MHC multimers are immobilized to a support e.g. beads, immunotubes, wells of a microtiterplate, CD, microchip or similar as described elsewhere herein, then a suspension of T cells (the sample) are added allowing specific T cells to bind MHC multimer molecules. Following washing bound T cells are recovered/eluted (e.g. using acid or competition with one or more competitor molecules) and counted.

Specific T-cells can e.g. be isolated through the use of bead-based MHC multimers. Bead-based MHC multimers are beads whereto monomer MHC-peptide complexes or MHC multimers are immobilized.

The isolated T cells can following elution optionally be manipulated further before final use. For example the isolated cells can be activated (to differentiate or proliferate), they can undergo induced apoptosis, or undesired cells of the isolated cell population can be removed. Then, the manipulated cell population can be re-introduced into the patient from which the sample originate, or can be introduced into another patient. A typical cell sorting experiment, based on bead-based MHC multimers, would follow some of the steps of the general procedure outlined in general terms in the following:

Acquire the sample, e.g. a cell sample from the blood or bone marrow of a cancer patient.

Block the sample with a protein solution, e.g. BSA or skim milk.

Block the beads coated with MHC complexes or MHC multimers, with BSA or skim milk.

Mix MHC-coated beads and the cell sample, and incubate.

Wash the beads with washing buffer, to remove unbound cells and non-specifically bound cells.

Isolate the immobilized cells, by either cleavage of the linker that connects MHC complex/MHC multimer and bead; or alternatively, release the cells by a change in pH, salt-concentration addition of competitive binding molecule or the like. Preferably, the cells are released under conditions that do not disrupt the integrity of the cells. Manipulate the isolated cells (e.g. induce apoptosis, proliferation or differentiation)

Direct Detection of T Cells in Solid Tissue
Direct Detection of T Cells in Solid Tissue In Vitro.

Example direct detection of T cells in solid tissue in vitro include but is not limited to Immunohistochemistry (IHC). IHC is here referred to as the detection of antigens in solid tissue by antibodies or other marker molecules labelled with a labelling molecule as described elsewhere herein.

For in vitro methods of the present invention solid tissue includes tissue, tissue biopsies, frozen tissue or tissue biopsies, paraffin embedded tissue or tissue biopsies and sections of either of the above mentioned. In a preferred method of this invention sections of fixed or frozen tissues are incubated with MHC multimer, allowing MHC multimer to bind to specific T cells in the tissue section. The MHC multimer may be labeled directly or through a labeled marker molecule. As an example, the MHC multimer can be labeled with a tag that can be recognized by e.g. a secondary antibody, optionally labeled with HRP or another label. The bound MHC multimer is then detected by its fluorescence or absorbance (for fluorophore or chromophore), or by addition of an enzyme-labeled antibody directed against this tag, or another component of the MHC multimer (e.g. one of the protein chains, a label on the multimerization domain). The enzyme can be Horse Raddish Peroxidase (HRP) or Alkaline Phosphatase (AP), both of which convert a colorless substrate into a colored reaction product in situ. This colored deposit identifies the binding site of the MHC multimer, and can be visualized under a light microscope. The MHC multimer can also be directly labeled with e.g. HRP or AP, and used in IHC without an additional antibody.

The tissue sections may derive from blocks of tissue or tissue biopsies embedded in paraffin, and tissue sections from this paraffin-tissue block fixed in formalin before staining. This procedure may influence the structure of the TCR in the fixed T cells and thereby influence the ability to recognize specific MHC complexes. In this case, the native structure of TCR needs to be at least partly preserved in the fixed tissue. Fixation of tissue therefore should be gentle. Alternatively, the staining is performed on frozen tissue sections, and the fixation is done after MHC multimer staining.

Direct Detection of T Cells in Solid Tissue In Vivo

For in vivo detection of T cells labeled MHC multimers are injected in to the body of the individual to be investigated. The MHC multimers may be labeled with e.g. a paramagnetic isotope. Using a magnetic resonance imaging (MRI) scanner or electron spin resonance (ESR) scanner MHC multimer binding T cells can then be measured and localized. In general, any conventional method for diagnostic imaging visualization can be utilized. Usually gamma and positron emitting radioisotopes are used for camera and paramagnetic isotopes for MRI.

The methods described above for direct detection of TCR embedded in lipid bilayers collectively called T cells using MHC multimers also applies to detection of TCR in solution and detection of TCR attached to or in a solid medium. Though detection of individual TCRs may not be possible when TCR is in solution.

Indirect Detection of TCR

Indirect detection of TCR is primarily useful for detection of TCRs embedded in lipid bilayer, preferably natural occurring T cells, T cell hybridomas or transfected T cells. MHC multimers used for the indirect detection may be generated and then added to sample. Alternatively MHC multimers are generated in sample by addition of antigenic peptide and/or antigenic polypeptide to sample and optionally also addition of MHC molecules, components of MHC molecules or MHC molecules coupled to carrier. For example when antigenic peptide and/or antigenic polypeptide is added to a sample containing antigen presenting cells, the antigenic peptide and/or antigenic polypeptide are taken up by antigen presenting cells in sample, processed inside cells and displayed on their surface by binding MHC molecules, or the antigenic peptides added are bound directly to MHC molecules displayed on the surface of antigen presenting cells by exchange with peptide already present in the peptide binding cleft of the MHC molecules.

In indirect detection, the number or activity of T cells are measured, by detection of events that are the result of TCR-MHC-peptide complex interaction. Interaction between MHC multimer and T cell may stimulate the T cell resulting in activation of T cells, in cell division and proliferation of T cell populations or alternatively result in inactivation of T cells. All these mechanism can be measured using various detection methods.

Indirect Detection of T Cells by Measurement of Activation

MHC multimers, e.g. antigen presenting cells, can stimulate T cells resulting in activation of the stimulated T cells. Activation of T cell can be detected by measurement of production of specific soluble factor from the stimulated T cell, e.g. production of cytokines like INFγ and IL2. Stimulation of T cells can also be detected by measurement of changes in expression of specific surface receptors, or by measurement of T cell effector functions.

Measurement of activation of T cells involves the following steps:

a) Antigenic peptide is added to a sample of T cells containing antigen presenting cells, preferably a suspension of cells e.g. blood. The antigenic peptide have to be able to bind MHC I or MHC II molecules of one or more antigen presenting cells in the sample thereby generating one or more cell based MHC multimer(s) in sample. Alternatively, antigenic polypeptide protein or protein fragment containing one or more antigenic peptides sequences is added to such sample. The protein/protein fragments antigenic polypeptide is then taken up by antigen presenting cells in sample, processed into antigenic peptides and presented by MHC molecules on the surface of antigen presenting cells thereby creating cell based MHC multimers in the sample. Several different antigenic peptides or antigenic proteins polypeptides may be added to the sample. The peptide-loaded antigen presenting cells (the cell based MHC multimers) can then stimulate specific T cells in sample, and thereby induce the production of soluble factor, up- or down-regulation of surface receptors, or mediate other changes in the T cell, e.g. enhancing effector functions.

Alternatively, one or more MHC multimer(s) containing one or more antigenic peptide(s) are added to a sample containing T cells, preferably a suspension of cells, to stimulate MHC multimer specific T cells in sample and thereby induce production of soluble factor, up- or down-regulation of surface receptor and/or other changes in the T cell.

Following addition of antigenic peptide, antigenic proteinantigenic polypeptide or MHC multimer to sample, a second soluble factor, e.g. cytokine and/or growth factor(s) may optionally be added to facilitate continued activation and expansion of antigen-specific T cells b) Detection of the presence of produced soluble factor, the presence/absence of surface receptor or detection of effector function.

Correlate the measured result with presence of T cells. The measured signal/response indicates the presence of specific T cells that have been stimulated with particular MHC multimer. The signal/response of a T lymphocyte population is a measure of the overall response in sample.

The frequency of specific T cells able to respond to a given MHC multimer can be determined by including a limiting-dilution culture in the assay also called a Limiting dilution assay.

The limiting-dilution culture method involves the following steps:

i. Sample of T cells in suspension are plated into culture wells at increasing dilutions.

ii. Antigen presenting cells are provided into the sample if not already in sample and then antigenic peptide or protein polypeptide containing one or more antigenic peptide sequence(s) is added to the sample as described above thereby creating cell based MHC multimers in sample able to stimulate antigen-specific T cells in the sample. Alternatively, already generated MHC multimers are added to sample to stimulate specific T cells.

Optionally growth factors, cytokines or other factors helping T cells to proliferate are added.

iii. Cells are allowed to grow and proliferate (½-several days). Each well that initially contained a specific T cell will make a response to the MHC multimer and divide.

iv. Wells are tested for a specific response e.g. production of soluble factors, cell proliferation, cytotoxicity or other effector functions.

The assay is replicated with different numbers of T cells in the sample, and each well that originally contained a specific T cell will make a response to the MHC multimer. The frequency of specific T cells in the sample equals the reciprocal of the number of cells added to each well when 37% of the wells are negative, because due to Poisson distribution each well then on average contained one specific T cell at the beginning of the culture.

Optionally step i) and ii) from above may be reversed, e.g. adding sample containing T cells in various dilutions to wells or containers containing MHC multimer, antigenic peptide, antigenic peptide+antigen presenting cells, antigenic polypeptide or antigenic polypeptide+antigen presenting cells or MHC multimer.

In the following various methods to measure production of specific soluble factor, expression of surface receptors, effector functions or proliferation is described.

Indirect Detection of T Cells by Measurement of Production of Soluble Factors.

Indirect Detection of T Cells by Measurement of Secreted Soluble Factors

Secreted soluble factors can be measured directly in fluid suspension or the soluble factor captured by immobilization on solid support and then detected or an effect of the secreted soluble factor can be detected.

Examples of such detection methods are interferon gamma release assays (IGRA's) like Quantiferon, enzyme-linked immunospot (ELISPOT) and cytokine flow cytometry (CFC), where INF-γ released from antigen stimulated T cells are measured. Principles of the various and alternative assays are described in more details below.

Indirect Detection of T Cells by Measurement of Secreted Soluble Factor Directly in Fluid Sample.

A sample of T cells are added MHC multimer and/or antigenic peptide as described above to induce production and secretion of soluble factors from antigen-specific T cells. The secreted soluble factors can be measured directly in the supernatant using e.g. mass spectrometry.

Indirect Detection of T Cells by Capture of Secreted Soluble Factor on Solid Support.

A sample of T cells are added MHC multimer and/or antigenic peptide as described above to induce production and secretion of soluble factors from antigen-specific T cells. Secreted soluble factors in the supernatant are then immobilized on a solid support either directly or through a linker as described for immobilization of T cells elsewhere herein. Then immobilized soluble factors can be detected using labeled marker molecules.

Soluble factors secreted from individual T cells can be detected using ELISPOT assays or related techniques. The principle is capturing of the secreted soluble factors locally by marker molecules, e.g antibodies specific for the soluble factor. Soluble factor recognized by marker molecules are immobilized on a solid support together with T cells and soluble factors secreted by individual T cells are thereby captured in the proximity of each T cell. Bound soluble factor can then be measured using labelled marker molecules specific for the captured soluble factor. The number of T cells that has given rise to labelled spots on solid support can then be enumerated and these spots indicate the presence of specific T cells that have been stimulated with particular MHC multimer and/or antigenic peptide and/or antigenic polypeptide.

Soluble factors secreted from a population of T cells are detected by capture and detection of soluble factor secreted from the entire population of specific T cells. In this case soluble factor do not have to be captured locally close to each T cell but the secreted soluble factors my be captured and detected in the same well or container as where the T cells are, or supernatant containing secreted soluble factor transferred to another solid support with marker molecules for capture e.g. beads or wells of ELISA plate. An example of such an assay is QuantiFERON or QuantiFERON like assays measuring secretion of INF-γ from antigen stimulated T cells.

Indirect Detection of T Cells Immobilized to Solid Support in a Defined Pattern.

Different MHC multimers, or MHC-peptide complexes are immobilized to a support to form a spatial array in a defined pattern, where the position specifies the identity of the MHC multimer/MHC-peptide complex immobilized at this position. Marker molecules able to bind T cell secreted soluble factors are co-spotted together with MHC multimer/MHC-peptide complex. Such marker molecules can e.g. be antibodies specific for cytokines like INFγ or IL-2. The immobilization may be direct or through a linker molecule as described above. Then a suspension of labeled T cells are added or passed over the array of MHC multimers/MHC-peptide complexes and specific T cells will bind to the immobilized MHC multimers/MHC-peptide complexes and upon binding be stimulated to secrete soluble factors e.g. cytokines like INFγ ord IL-2. Soluble factors secreted by individual T cells are then captured in the proximity of each T cell and bound soluble factor can be measured using labelled marker molecule specific for the soluble factor. The number and position of different specific T cells that has given rise to labelled spots on solid support can then be identified and enumerated. In this way T cells bound to defined areas of the support are analyzed, thereby, phenotyping the sample. Each individual T cell is defined by the TCR it expose and depending on these TCRs each entity will bind to different types of MHC multimers/MHC-peptide complexes immobilized at defined positions on the solid support.

Alternatively to MHC multimers or MHC-peptide complexes antigenic peptides or antigenic polypeptides can be immobilized to a support to form a spatial array in a defined pattern, where the position specifies the identity of the antigenic peptide/antigenic polypeptide immobilized. As described above marker molecules able to bind T cell secreted soluble factors are co-spotted together with antigenic peptide/antigenic polypeptide. Before or together with addition of the suspension of T cells, MHC molecules, components of MHC molecules or MHC molecules attached to carrier are added to the array thereby generating MHC multimers. Then antigen specific T cells in sample are detected as described above.

Indirect Detection of T Cells by Measurement of Secreted Soluble Factor on Surface of T Cell An alternative way to detect secretion of soluble factor from individual cells is to use soluble factor capture on the surface of the T cell secreting the soluble factor. This can be done by using a bispecific capture molecule able to bind a component on the surface of the T cell with one part of the capture molecule and bind the secreted soluble factor by another part of the capture molecule. Example useful capture molecules are bispecific antibodies in which two different heavy- and light chain pairs from different antibodies are combined in one antibody resulting in an antibody molecule with the two antigen-binding sites recognizing different ligands.

Activated T cells in a sample can then be detected by adding the bispecific capture molecules to the sample. These molecules will then bind all T cells with on part of the molecule. T cells secreting soluble factor (due to activation) will then capture the secreted soluble factor on their surface by the soluble factor binding part of the capture molecule. Bound soluble factor can then be detected by addition of a labelled marker molecule specific for the soluble factor in question.

Indirect Detection of T Cells by Measurement of Effect of Secreted Soluble Factor.

Secreted soluble factors can be measured and quantified indirectly by measurement of the effect of the soluble factor on other cell systems. Briefly, a sample of T cells are added MHC multimer or antigenic peptide as described above to induce secretion of soluble factors from antigen-specific T cells. The supernatant containing secreted soluble factor are transferred to another cell system and the effect measured. The soluble factor may induce proliferation, secretion of other soluble factors, expression/downregulation of receptors, or the soluble factor may have cytotoxic effects on these other cells. All effects can be measured as described elsewhere herein.

Indirect Detection of T Cells by Measurement of Produced Soluble Factors Intracellularly Production of soluble factors can be measured intracellularly using flow cytometry. Often cytokines are measured and the method is therefore referred to as cytokine flow cytometry (CFC). The principles are described below.

Soluble factor production by stimulated T cells can also be measured intracellular by e.g. flow cytometry. This can be done using block of secretion of soluble factor (e.g. by monensin), permeabilization of cell (by e.g. saponine) followed by immunofluorescent staining. The method involves the following steps: 1) Stimulation of T cells e.g. by binding specific MHC multimers: The MHC multimers may be generated and added to sample containing T cells or antigenic peptide or protein polypeptide containing antigenic peptide sequences can be added to sample and MHC multimers generated in sample as described elsewhere herein. An example of useful MHC multimers for stimulation of specific T cells is antigen presenting cells displaying MHC molecules containing antigenic peptide. A reagent able to block extracellular secretion of cytokine is added during stimulation, e.g. monensin that interrupt intracellular transport processes leading to accumulation of produced soluble factor, e.g. cytokine in the Golgi complex. Other soluble factors may be added to the T cell sample during stimulation to enhance activation and/or expansion. This other soluble factor can be cytokine and or growth factors. 2) addition of one or more labelled marker molecules able to detect special surface receptors (e.g. marker molecules able to bind CD8, CD4, CD3, CD27, CD28, CD2). 3) Fixation of cell membrane using mild fixator followed by permeabilization of cell membrane e.g. by saponine. 4) Addition of labelled marker specific for the produced soluble factor to be determined, e.g. INFγ, IL-2, IL-4, IL-10. 5) Measurement of labelled cells using a flow cytometer.

An alternative to this procedure is to trap secreted soluble factors on the surface of the secreting T cell as described elsewhere herein or as described by Manz, R. et al., Proc. Natl. Acad. Sci. USA 92:1921 (1995).

Indirect Detection of T Cells by Measurement of Expression of Receptors

Activation of T cells can be detected by measurement of expression and/or down regulation of specific surface receptors. The method includes the following steps. A sample of T cells are added MHC multimer, antigenic peptide as described elsewhere herein to stimulate T cell and thereby induce expression or downregulation of specific surface receptors on antigen-specific T cells. These receptors include but are not limited to CD28, CD27, CCR7, CD45RO, CD45RA, IL2-receptor, CD62L, CCR5. Their expression level can be detected by addition of labelled marker specific for the desired receptor and then measure the amount of labelled cells using flow cytometry, microscopy, immobilization of activated T cell on solid support or any other method like those described for direct detection of TCR.

Indirect Detection of T Cells by Measurement of Effector Function

Activation of T cells can be detected indirectly by measurement of effector functions. A sample of T cells are added MHC multimer, antigenic peptide as described elsewhere herein to stimulate T cell and thereby induce one or more effector functions of the antigen-specific T cells. The one or more effector function(s) are then measured. For example activation of antigen-specific CD8 positive T cells can be determined by measurement of killing of target cells, i.e. cells displaying specific MHC-peptide complexes recognized by the activated antigen-specific CD8 positive T cell. This method is often referred to as cytotoxicity assays or CTL killing assays and involves the following steps:

1) Sample containing antigen-specific CD8 positive cells are stimulated by addition of MHC multimer, antigenic peptide as described elsewhere herein. 2) Another sample containing live target cells displaying MHC I molecules containing specific antigenic peptide are added labelled molecules that can be taken up by live cells but that are not spontaneously released by the target cells following uptake e.g. radioactive labelled compounds. 3) Stimulated and activated T cells from step 1 are then added to target cells of step 2. target cells displaying the MHC complexes containing specific antigenic peptide(s) are then killed releasing labelled compound from the target cells and the presence of this labelled compound may be detected in the supernatant of mixtures of target and cytotoxic cells. Alternatively, amount of labelled compound in cells that are not killed by the CD8 positive T cells are measured, by removing labelled compound released by killed target cells followed by measurement of label inside remaining cells either directly or by release of the labelled compound from these remaining cells.

Indirect Detection of T Cells by Measurement of Proliferation

T cells can be stimulated to proliferate upon binding specific MHC multimers. Proliferation of T cells can be measured several ways including but not limited to:

Detection of mRNA

Proliferation of T cells can be detected by measurement of mRNA inside cell. Cell division and proliferation requires production of new protein in each cell which as an initial step requires production of mRNA encoding the proteins to be synthesized. A sample of T cells are added MHC multimer or antigenic peptide as described above to induce proliferation of antigen-specific T cells. Detection of levels of mRNA inside the proliferating T cells can be done by quantitative PCR and indirectly measure activation of a T cell population as a result of interaction with MHC multimer. An example is measurement of cytokine mRNA by in situ hybridization.

Detection of Incorporation of Thymidine

The proliferative capacity of T cells in response to stimulation by MHC multimer can be determined by a radioactive assay based on incorporation of [$^3$H]thymidine ([$^3$H]TdR) into newly generated DNA followed by measurement of radioactive signal.

Detection of Incorporation of BrdU

T cell proliferation can also be detected by of incorporation of bromo-2'-deoxyuridine (BrdU) followed by measurement of incorporated BrdU using a labeled anti-BrdU antibody in an ELISA based analysis.

Viability of cells may be measured by measurement ATP in a cell culture.

Indirect Detection of T Cells by Measurement of Inactivation

Not all MHC multimers will lead to activation of the T cells they bind. Under certain circumstances some MHC multimers may rather inactivate the T cells they bind to.

Indirect Detection of T Cells by Measurement of Effect of Blockade of TCR

Inactivation of T cells by MHC multimers may be measured be measuring the effect of blocking TCR on antigen-specific T cells. MHC multimers, e.g. MHC-peptide complexes coupled to IgG scaffold can block the TCR of an antigen-specific T cell by binding the TCR, thereby prevent the blocked T cell receptor interacting with e.g. antigen presenting cells. Blockade of TCRs of a T cell can be detected in any of the above described methods for detection of TCR by addition of an unlabeled blocking MHC multimer together with the labelled MHC multimer and then measuring the effect of the blockade on the readout.

Indirect Detection of T Cells by Measurement of Induction of Apoptosis

Inactivation of T cells by MHC multimers may be measured be measuring apoptosis of the antigen-specific T cell. Binding of some MHC multimers to specific T cells may lead to induction of apoptosis. Inactivation of T cells by binding MHC multimer may therefore be detected by measuring apoptosis in the T cell population. Methods to measure apoptosis in T cells include but are not limited to measurement of the following:

DNA fragmentation

Alterations in membrane asymmetry (phosphatidylserine translocation)

Activation of apoptotic caspases

Release of cytochrome C and AIF from mitochondria into the cytoplasm

Positive Control Experiments for the Use of MHC Multimers in Flow Cytometry and Related Techniques When performing flow cytometry experiments, or when using similar technologies, it is important to include appropriate positive and negative controls. In addition to establishing proper conditions for the experiments, positive and negative control reagents can also be used to evaluate the quality (e.g. specificity and affinity) and stability (e.g. shelf life) of produced MHC multimers.

The quality and stability of a given MHC multimer can be tested in a number of different ways, including:

Measurement of specific MHC multimer binding to beads, other types of solid support, or micelles and liposomes, to which TCR's have been immobilized. Other kinds of molecules that recognize specifically the MHC-peptide complex can be immobilized and used as well. Depending on the nature of the solid support or membrane structure to which the TCR is immobilized, the TCR can be full-length (i.e. comprise the intracellular- and intra-membrane domains), or can be truncated (e.g. only comprise the extracellular domains). Likewise, the TCR can be recombinant, and can be chemically or enzymatically modified.

Measurement of MHC multimer binding to beads, other types of solid support, or micelles and liposomes, to which aptamers, antibodies or other kinds of molecules that recognize correctly folded MHC-peptide complexes have been immobilized.

Measurement of specific MHC multimer binding to specific cell lines (e.g. T-cell lines) displaying MHC multimer-binding molecules, e.g. displaying TCRs with appropriate specificity and affinity for the MHC multimer in question.

Measurement of specific MHC multimer binding to cells in blood samples, preparations of purified lymphocytes (HPBMCs), or other bodily fluids that contain cells carrying receptor molecules specific for the MHC multimer in question.

Measurement of specific MHC multimer binding to soluble TCRs, aptamers, antibodies, or other soluble MHC-peptide complex-binding molecules, by density-gradient centrifugation (e.g. in CsCl) or by size exclusion chromatography, PAGE or other type of chromatographic method.

Measurement of specific MHC binding to TCRs, aptamers, antibodies, streptavidin, or other MHC-peptide complex-binding molecules immobilized on a solid surface (e.g. a microtiter plate). The degree of MHC multimer binding can be visualized with a secondary component that binds the MHC multimer, e.g. a biotinylated fluorophore in cases where the MHC multimer contains streptavidin proteins, not fully loaded with biotin. Alternatively, the secondary component is unlabelled, and a labelled second component-specific compound is employed (e.g. EnVision System, Dako) for visualization. This solid surface can be beads, immunotubes, microtiterplates act. The principle for purification are basically the same I.e. T cells are added to the solid with immobilized MHC'mer, non-binding T cells are washed away and MHC-peptide specific T cells can be retrieved by elution with mild acid or a competitive binding reagent.

Measurement of specific MHC multimer binding to TCRs, aptamers, antibodies, streptavidin, or other MHC-peptide complex-binding molecules immobilized on a solid surface (e.g. a microtiter plate) visualized with a secondary component specific to MHC multimer (e.g. TCRs, aptamers, antibodies, streptavidin, or other MHC-peptide binding complex-binding molecules). Alternatively the secondary receptor is unlabelled, and a labelled second receptor-specific compound is employed (e.g. EnVision System, Dako) before visualization.

In the above mentioned approaches, positive control reagents include MHC multimers comprising correctly folded MHC, complexed with an appropriate peptide that allows the MHC multimer to interact specifically and efficiently with its cognate TCR. Negative control reagents include empty MHC multimers, or correctly folded MHC multimers complexed with so-called nonsense peptides that support a correct conformation of the MHC-peptide complex, but that do not efficiently bind TCRs through the peptide-binding site of the MHC complex.

Negative Control Reagents and Negative Control Experiments for the Use of MHC Multimers in Flow Cytometry and Related Techniques Experiments with MHC multimers require a negative control in order to determine background staining with MHC multimer. Background staining can be due to unwanted binding of any of the individual components of the MHC multimer, e.g., MHC complex or individual components of the MHC complex, multimerization domain or label molecules. The unwanted binding can be to any surface or intracellular protein or other cellular structure of any cell in the test sample, e.g. undesired binding to B cells, NK cells or T cells. Unwanted binding to certain cells or certain components on cells can normally be corrected for during the analysis, by staining with antibodies that bind to unique surface markers of these specific cells, and thus identifies these as false positives, or alternatively, that bind to other components of the target cells, and thus identifies these cells as true positives. A negative control reagent can be used in any experiment involving MHC multimers, e.g. flow cytometry analysis, other cytometric methods, immunohistochemistry (IHC) and ELISA. Negative control reagents include the following:

MHC complexes or MHC multimers comprising MHC complexes carrying nonsense peptides. A nonsense peptide is here to be understood as a peptide that binds the MHC protein efficiently, but that does not support binding of the resultant MHC-peptide complex to the desired TCR. An example nonsense peptide is a peptide with an amino acid sequence different from the linear sequence of any peptide derived from any known protein. When choosing an appropriate nonsense peptide the following points are taken into consideration. The peptide should ideally have appropriate amino acids at relevant positions that can anchor the peptide to the peptide-binding groove of the MHC. The remaining amino acids should ideally be chosen in such a way that possible binding to TCR (through interactions with the peptide or peptide-binding site of MHC) are minimized. The peptide should ideally be soluble in water to make proper folding with MHC alpha chain and β2m possible in aqueous buffer. The length of the peptide should ideally match the type and allele of MHC complex. The final peptide sequence should ideally be taken through a blast search or similar analysis, to ensure that it is not identical with any peptide sequence found in any known naturally occurring proteins.

MHC complexes or MHC multimers comprising MHC complexes carrying a chemically modified peptide in the peptide-binding groove. The modification should ideally allow proper conformation of the MHC-peptide structure, yet should not allow efficient interaction of the peptide or peptide-binding site of MHC with the TCR.

MHC complexes or MHC multimers comprising MHC complexes carrying a naturally occurring peptide different from the peptide used for analysis of specific T cells in the sample. When choosing the appropriate natural peptide the following should be taken into consideration. The peptide in complex with the MHC protein should ideally not be likely to bind a TCR of any T cell in the sample with such an affinity that it can be detected with the applied analysis method. The peptide should ideally be soluble in water to make proper folding with MHC alpha chain and β2m possible in aqueous buffer. The length of the peptide should match the type and allele of MHC complex.

Empty MHC complexes or MHC multimers comprising empty MHC complexes, meaning any correctly folded MHC complex without a peptide in the peptide-binding groove.

MHC heavy chain or MHC multimers comprising MHC heavy chain, where MHC heavy chain should be understood as full-length MHC I or MHC II heavy chain or any truncated version of MHC I or MHC II heavy chain. The MHC heavy chains can be either folded or unfolded. Of special interest is MHC I alpha chains containing the α3 domain that binds CD8 molecules on cytotoxic T cells. Another embodiment of special interest is MHC p chains containing the β2 domain that binds CD4 on the surface of helper T cells.

Beta2microglobulin or subunits of beta2microglobulin, or MHC multimers comprising Beta2microglobulin or subunits of beta2microglobulin, folded or unfolded.

MHC-like complexes or MHC multimers comprising MHC-like complexes, folded or unfolded. An example could be CD1 molecules that are able to bind peptides in a peptide-binding groove that can be recognized by T cells (Russano et al. (2007). CD1-restricted recognition of exogenous and self-lipid antigens by duodenal gammadelta+T lymphocytes. J Immunol. 178(6):3620-6)

Multimerization domains without MHC or MHC-like molecules, e.g. dextran, streptavidin, IgG, coiled-coil-domain liposomes.

Labels, e.g. FITC, PE, APC, pacific blue, cascade yellow, or any other label listed elsewhere herein.

Negative controls 1-4 can provide information about potentially undesired binding of the MHC multimer, through interaction of a surface of the MHC-peptide complex different from the peptide-binding groove and its surroundings. Negative control 5 and 6 can provide information about binding through interactions through the MHC I or MHC II proteins (in the absence of peptide). Negative control 7 can provide information about binding through surfaces of the MHC complex that is not unique to the MHC complex. Negative controls 8 and 9 provide information about potential undesired interactions between non-MHC-peptide complex components of the MHC multimer and cell constituents.

Minimization of Undesired Binding of the MHC Multimer

Identification of MHC-peptide specific T cells can give rise to background signals due to unwanted binding to cells that do not carry TCRs. This undesired binding can result from binding to cells or other material, by various components of the MHC multimer, e.g. the dextran in a MHC dextramer construct, the labelling molecule (e.g. FITC), or surface regions of the MHC-peptide complex that do not include the peptide and the peptide-binding cleft.

MHC-peptide complexes bind to specific T cells through interaction with at least two receptors in the cell membrane of the T-cell. These two receptors are the T-cell receptor (TCR) and CD8 for MHC I-peptide complexes and TCR and CD4 receptor protein for MHC II-peptide complexes. Therefore, a particularly interesting example of undesired binding of a MHC multimer is its binding to the CD8 or CD4 molecules of T cells that do not carry a TCR specific for the actual MHC-peptide complex. The interaction of CD8 or CD4 molecules with the MHC is not very strong; however, because of the avidity gained from the binding of several MHC complexes of a MHC multimer, the interaction between the MHC multimer and several CD8 or CD4 receptors potentially can result in undesired but efficient binding of the MHC multimer to these T cells. In an analytical experiment this would give rise to an unwanted background signal; in a cell sorting experiment undesired cells might become isolated. Other particular interesting examples of undesired binding is binding to lymphoid cells different from T cells, e.g. NK-cells, B-cells, monocytes, dendritic cells, and granulocytes like eosinophils, neutrophils and basophiles.

Apart from the MHC complex, other components in the MHC multimer can give rise to unspecific binding. Of special interest are the multimerization domain, multimerization domain molecules, and labelling molecules.

One way to overcome the problem with unwanted binding is to include negative controls in the experiment and subtract this signal from signals derived from the analyzed sample, as described elsewhere in the invention.

Alternatively, unwanted binding could be minimized or eliminated during the experiment. Methods to minimize or eliminate background signals include:

Mutations in areas of the MHC complex responsible for binding to unwanted cells can be introduced. Mutations here mean substitution, insertion, or deletion of natural or non-natural amino acids. Sub-domains in the MHC complex can be responsible for unwanted binding of the MHC multimer to cells without a TCR specific for the MHC-peptide complex contained in the MHC multimer. One example of special interest is a small region in the α3-domain of the α-chain of MHC I molecules that is responsible for binding to CD8 on all cytotoxic T cells. Mutations in this area can alter or completely abolish the interaction between CD8 on cytotoxic T cells and MHC multimer (Neveu et al. (2006) Int Immunol. 18, 1139-45). Similarly a sub domain in the β2 domain of the β-chain of MHC II molecules is responsible for binding CD4 molecules on all CD4 positive T cells. Mutations in this sub domain can alter or completely abolish the interaction between MHC II and CD4.

Another embodiment is to mutate other areas of MHC I/MHC II complexes that are involved in interactions with T cell surface receptors different from TCR, CD8 and CD4, or that bind surface receptors on B cells, NK cells, Eosiniophils, Neutrophils, Basophiles, Dendritic cells or monocytes.

Chemical alterations in areas of the MHC complex responsible for binding to unwanted cells can be employed in order to minimize unwanted binding of MHC multimer to irrelevant cells. Chemical alteration here means any chemical modification of one or more amino acids. Regions in MHC complexes that are of special interest are as mentioned above the α3 domain of the α-chain in MHC I molecules and β2 domains in the β-chain of MHC II molecules. Other regions in MHC I/MHC II molecules that can be chemically modified to decrease the extent of undesired binding are regions involved in interaction with T cell surface receptors different from TCR, CD8 and CD4, or that bind surface receptors on B cells, NK cells, Eosiniophils, Neutrophils, Basophiles, Dendritic cells or monocytes.

Another method to minimize undesired binding involves the addition of one or more components of a MHC multimer, predicted to be responsible for the unwanted binding. The added component is not labeled, or carries a label different from the label of the MHC multimer used for analysis. Of special interest is addition of MHC multimers that contain nonsense peptides, i.e. peptides that interact efficiently with the MHC protein, but that expectably do not support specific binding of the MHC multimer to the TCR in question. Another example of interest is addition of soluble MHC complexes not coupled to a multimerization domain, and with or without peptide bound in the peptide binding cleft. In another embodiment, individual components of the MHC complex can be added to the sample, e.g. I α-chain or subunits of MHC I α-chain either folded or unfolded, beta2microglobulin or subunits thereof either folded or unfolded, α/β-chain of MHC II or subunits thereof either folded or unfolded. Any of the above mentioned individual components can also be attached to a multimerization domain identical or different from the one used in the MHC multimer employed in the analysis.

Of special interest is also addition of multimerization domain similar or identical to the multimerization domain used in the MHC multimer or individual components of the multimerization domain.

Reagents able to identify specific cell types either by selection or exclusion can be included in the analysis to help identify the population of T cells of interest, and in this way deselect the signal arising from binding of the MHC multimer to undesired cells.

Of special interest is the use of appropriate gating reagents in flow cytometry experiments. Thus, fluorescent antibodies directed against specific surface markers can be used for identification of specific subpopulations of cells, and in this way help to deselect signals resulting from MHC multimers binding to undesired cells. Gating reagents of special interest that helps identify the subset of T cells of interest when using MHC I multimers are reagents binding to CD3 and CD8 identifying all cytotoxic T cells. These reagents are preferably antibodies but can be any labeled molecule capable of binding CD3 or CD8. Gating reagents directed against CD3 and CD8 are preferably used together. As they stain overlapping cell populations they are preferably labeled with distinct fluorochromes. However, they can also be used individually in separate samples. In experiments with MHC multimers reagents binding to CD3 and CD4 identifying T helper cells can be used. These reagents are preferably antibodies but can be any labeled molecule capable of binding CD3 or CD4. Gating reagents directed against CD3 and CD4 are preferable used together. As they stain overlapping cell populations they are preferably labeled with distinct fluorochromes. However, they can also be used individually in separate samples.

Other gating reagents of special interest in experiments with any MHC multimer, are reagents binding to the cell surface markers CD2, CD27, CD28, CD45RA, CD45RO, CD62L and CCR7. These surface markers are unique to T cells in various differentiation states. Co staining with either of these reagents or combinations thereof together with MHC multimers helps to select MHC multimer binding T cells expressing a correct TCR. These reagents can also be combined with reagents directed against CD3, CD4 and/or CD8.

Another flow cytometric method of special interest to remove signals from MHC multimer stained cells not expressing the specific TCR, is to introduce an exclusion gate. Antibodies or other reagents specific for surface markers unique to the unwanted cells are labeled with a fluorochrome and added to the test sample together with the MHC multimer. The number of antibodies or surface marker specific reagents are not limited to one but can be two, three, four, five, six, seven, eight, nine, ten or more individual reagents recognizing different surface markers, all of which are unique to the unwanted cells. During or after collection of data all events representing cells labeled with these antibodies are dumped in the same gate and removed from the dataset. This is possible because all the antibodies/reagents that bind to the wrong cells are labeled with the same fluorochrome.

Reagents of special interest that exclude irrelevant cells include reagents against CD45 expressed on red blood cells, CD19 expressed on B cells, CD56 expressed on NK cells, CD4 expressed on T helper cells and CD8 expressed on cytotoxic T cells, CD14 expressed on monocytes and CD15 expressed on granulocytes and monocytes.

EXAMPLES

Example 1

This example describes how to make an MHC class I complex with a peptide in the peptide binding-groove using in vitro refolding. The MHC-complex in this example consisted of light chain β2m, the MHC class I Heavy Chain allele HLA-A*0201 (a truncated version in which the intracellular and transmembrane domains have been deleted) and one of the peptides

|  |  |
|---|---|
| YLNTKSNGNYEI, | (SEQ ID NO: 359) |
| FLSIFTQGYT, | (SEQ ID NO: 241) |
| GIYDLILNA, | (SEQ ID NO: 2761) |
| YIKDINEFI, | (SEQ ID NO: 4479) |
| IQIEIEQLTDEI, | (SEQ ID NO: 5126) |
| RMISDQRANLGA, | (SEQ ID NO: 5127) |
| SQGGVNSPV, | (SEQ ID NO: 5112) |
| MLDEAKDKL, | (SEQ ID NO: 5516) |
| FMEQATNSWI, | (SEQ ID NO: 5530) |
| NLVFSSLFL or | (SEQ ID NO: 5510) |
| KLAESIYKRL. | (SEQ ID NO: 5531) |

MHC I-complexes consists of 3 components; Light Chain (β2m), Heavy Chain and a peptide of typically 8-10 amino acids. In this example MHC-complexes was generated by in vitro refolding of heavy chain, β2m and peptide in a buffer containing reduced and oxidized glutathione. By incubation in this buffer a non-covalent complex between Heavy Chain, β2m and peptide was formed. Heavy chain and β2m was expressed as inclusion bodies in *E. coli* prior to in vitro refolding following standard procedures as described in Garboczi et al., (1996), Nature 384, 134-141. Following refolding the MHC complexes was biotinylated using BirA enzyme able to biotinylate a specific amino acid residue in a recognition sequence fused to the C-terminal of the Heavy Chain by genetic fusion. Monomer MHC complexes was then purified by size exclusion chromatography.

1. 200 ml of refolding buffer (100 mM Tris, 400 mM L-arginin-HCL, 2 mM NaEDTA, 0.5 mM oxidized Gluthathione, 5 mM reduced Glutathione, pH 8.0) was supplied with protease inhibitors PMSF (phenylmethylsulphonyl fluoride), Pepstatin A and Leupeptin (to a final concentration of 1 mM, 1 mg/l and 1 mg/l, respectively). The refolding buffer was placed at 10° C. on a stirrer.
2. 12 mg of peptide

YLNTKSNGNYEI, (SEQ ID NO: 359)

FLSIFTQGYT, (SEQ ID NO: 241)

GIYDLILNA, (SEQ ID NO: 2761)

YIKDINEFI, (SEQ ID NO: 4479)

IQIEIEQLTDEI, (SEQ ID NO: 5126)

RMISDQRANLGA, (SEQ ID NO: 5127)

SQGGVNSPV, (SEQ ID NO: 5112)

MLDEAKDKL, (SEQ ID NO: 5516)

FMEQATNSWI, (SEQ ID NO: 5530)

NLVFSSLFL (SEQ ID NO: 5510)
or

KLAESIYKRL (SEQ ID NO: 5531)

was dissolved in DMSO or another suitable solvent (300-500 µl) and added drop-wise to the refolding buffer at vigorous stirring.

3. 4.4 mg of human Light Chain β2m was added drop-wise to the refolding buffer at vigorous stirring.
4. 6.2 mg of Heavy Chain HLA-A*0201 (supplied with DTT to a concentration of 0.1 mM) was added drop-wise to the refolding buffer at vigorous stirring.
5. The folding reaction was placed at 10° C. at slow stirring for 4-8 hours.
6. After 4-8 hours, step 3 and 4 was repeated and the folding reaction is placed at 10° C. at slow stirring O/N.
7. Step 3 and 4 was repeated, and the folding reaction is placed at 10° C. at slow stirring for 6-8 hours.

Optionally, steps 5-7 may be done in less time, e.g. a total of 0.5-5 hours.

8. After 6-8 hours the folding reaction was filtrated through a 0.2 µm filter to remove aggregates.
9. The folding reaction was concentrated O/N at 10° C. shaking gently in a suitable concentrator with a 5000 mw cut-off filter. The folding reaction was concentrated to approximately 5-10 ml. (Optionally the filtrate can be stored at 4° C. and reused for another folding with the same peptide and heavy chain.)
10. The concentrated folding reaction was buffer-exchanged at least 8 times, into an MHC-buffer (20 mM Tris-HCl, 50 mM NaCl, pH 8.0) and concentrated (at 10° C. in a suitable concentrator with a 5000 mw cut-off filter) down to approximately 1 ml.
11. The heavy chain part of the MHC-complex was biotinylated by mixing the following components: approximately 1000 µl folded MHC-complex, 100 µl each of Biomix-A, Biomix-B and d-Biotin (all 3 from Biotin Protein Ligase Kit from Avidity, 10 µl birA enzyme (3 mg/ml, from Biotin Protein Ligase Kit from Avidity, 0.5 µl Pepstatin A (2 mg/ml) and 0.5 µl Leupeptin (2 mg/ml). The above was gently mixed and incubated O/N at room temperature.
12. The biotinylated and folded MHC-complex solution was centrifuged for 5 min. at 1700×g, room temperature.
13. Correctly folded MHC-complex was separated and purified from excess biotin, excess β2m, excess heavy chain and aggregates thereof, by size exclusion chromatography on a column that separates proteins in the 10-100 kDa range. Correctly folded monomer MHC-complex was eluted with a MHC-buffer (20 mM Tris-HCl, 50 mM NaCl, pH 8.0). The elution profile consisted of 4 peaks, corresponding to aggregated Heavy Chain, correctly folded monomer MHC-complex, β2m and excess biotin and peptide (See FIG. 7A-K).
14. Fractions containing the folded MHC-complex were pooled and concentrated to approximately 1 ml in a suitable concentrator with a 5000 mw cut-off filter. The protein-concentration was estimated from its absorption at 280 nm.
15. Folded MHC-complex can optionally be stored at −170° C. before further use.
16. The grade of biotinylation was analysed by an SDS PAGE SHIFT-assay with Streptavidin (FIG. 8A-K) and correct folding was confirmed by ELISA, using the antibody W6/32 that recognizes correctly folded MHC-peptide complex.

The above procedure may be used for folding any MHC I complexes consisting of any β2m, any heavy chain and any peptide approx. 8-11 amino acids long. Either of the components can be truncated or otherwise modified. The above procedure can also be used for generation of "empty" MHC I complex consisting of β2m and heavy chain without peptide.

Example 2

This is an example of how to make an MHC multimer that is a tetramer and where the MHC are attached to the multimerization domain through a non-covalent interaction. The multimerization domain consist of Streptavidin. The MHC molecule is biotinylated, folded MHC-complex composed of β2m, HLA-A*0201 heavy chain and the peptide GIYDLILNA (SEQ ID NO: 2761) derived from the *Borrelia* specific antigen, DbpA. The biotinylated MHC-peptide complexes are generated as described in a previous example herein.

Fluorescent HLA-A*0201-peptide tetramer complexes are assembled by addition of ultra-avidin-R-PE (Leinco Technologies, St. Louis, Mo.) at a final molar ratio of biotinylated to HLA-A*0201-peptide ultra-avidin-R-PE of 6:1. The resulting HLA-A*0201-peptide multimer complexes are subjected to size exclusion on a Superdex-200 column to separate the tetramer complexes from protein aggregates and lower molecular weight complexes and excess free HLA-A*0201-peptide. The tetramer complexes

Example 3

This is an example of generation of a multimerization domain. The multimerization domain, an activated divinylsylfone-dextran(270 kDa)(VS-dex270), was coupled with streptavidin (SA) and labelled with Allophycocyanin (APC).
1. Streptavidin (approx. 100 mg SA/ml in 10 mM HEPES, 0,1M NaCl, pH 7.85) was dialysed with gentle stirring for 2 days against 10 mM HEPES, 0.1M NaCl, pH 7.85 (20 fold excess volume) at 2-8° C. with 1 buffer change/day.
2. 5 ml of APC from a homogen suspension (approx. 10 mg/ml) was centrifuged 40 min. at 3000 rpm. The supernatant was discharged, and the precipitate dissolved in 5 ml of 10 mM HEPES, 0,1M NaCl, pH 7.85. This APC solution was dialysed with gentle stirring in the dark for 2 days against 10 mM HEPES, 0.1M NaCl, pH 7.85 (20 fold excess volume) at 2-8° C. with 1 buffer change/day.
3. The APC-solution was concentrated to 1 ml and the concentration measured to 47 g/L at UV 650 nm. The A650/A278-ratio was measured to 4.2.
4. The SA-solution was filtrated through a 0.45 μm filter and the protein concentration was measured to 61.8 g SA/L at UV 278 nm.
5. Conjugation: The reagents was mixed to a total volume of 500 μl in the following order with 8.1 mol SA/mol Dex and 27 mol APC/mol Dex.:
   a) 90 μl water
   b) 160 μl activated VS-dex270
   c) 23 μl SA (61.8 g/L)~8.1 equivalents,
   d) 177 μl APC (47 g/L)~ 27 equivalents,
   e) 50 μl of 100 mM HEPES, 1M NaCl, pH 8

The reaction was placed in a water bath with stirring at 30° C. in the dark for 18 hours.
6. The coupling was stopped by adding 50 μl 0,1M ethanolamine, pH 8.0.
7. The conjugate was purified on a Sephacryl S-200 column with 10 mM HEPES, 0,1M NaCl buffer, pH 7.2.
8. 3 peaks were collected (peak 1: APC-SA-dex270; peak 2: Free APC; peak 3: Free SA). Volume, UV A650 and UV A278 were measured.
9. The concentration of dextran270, APC/Dex and SA/Dex were calculated to $22.4 \times 10^{-8}$ M; 3.48 and 9.54 respectively.
10. The conjugate was added $NaN_3$ and BSA to a final concentration of 15 mM and 1% respectively. The volume was adjusted with 10 mM HEPES, 0.1M NaCl, pH 7.2 to a final concentration of $16 \times 10^{-8}$ M Dex270.
11. The conjugate was kept at 2-8° C. in dark until further use.

Example 4

This is an example of generation of a multimerization domain. The multimerization domain is an activated divinylsylfone-dextran(270 kDa)(VS-dex270) coupled with streptavidin (SA) and the label is R-phycoerythrin (RPE). The coupling procedure described for coupling of SA and APC to VS-dex270 (as described elsewhere herein) was followed with the exception that APC was replaced with RPE.

Example 5

This is an example of how to couple MHC-peptide complexes to a multimerization domain, where the multimerization domain is dextran.

This example describes how to couple an empty MHC or a MHC-complex to a dextran multimerization domain through a non-covalent coupling, to generate a MHC-dextramer. The MHC-dextramer in this example consisted of APC-streptavidin (APC-SA)-conjugated 270 kDA dextran and a biotinylated, folded MHC-complex composed of β2m, HLA-A*0201 heavy chain and the peptide NLVPMVATV (SEQ ID NO: 5914). The APC-SA conjugated 270 kDA dextran contained 3,7 molecules of SA per dextran (each SA can bind 3 MHC-complexes) and the concentration was $16 \times 10^{-8}$ M. The concentration of the HLA-A*0201/NLVPMVATV (SEQ ID NO: 5914)-complex was 4 mg/ml (1 μg=20,663 μmol). The molecular concentration of the MHC-complex was $8,27 \times 10^{-5}$ M.

The MHC-complex was attached to the dextran by a non-covalent Biotin-Streptavidin interaction between the biotinylated Heavy Chain part of the MHC-complex and the SA, conjugated to dextran.

Here follows a protocol for how to produce 1000 μl of a MHC-dextramer solution with a final concentration of approximately $32 \times 10^{-9}$ M:

200 μL 270 kDA vinylsulfone-activated dextran, corresponding to $3,2 \times 10^{-11}$ mol, and 4 μl MHC-complex, corresponding to $3,55 \times 10^{-10}$ mol was mixed and incubated at room temperature in the dark for 30 min.
1. A buffer of 0,05M Tris-HCl, 15 mM $NaN_3$, 1% BSA, pH 7,2 was added to a total volume of 1000 μl.
2. The resulting MHC-dextramer preparation may now be used in flow cytometry experiments.

Example 6

This is an example of how to make and use MHC multimers that are trimers consisting of a streptavidin multimerization domain with 3 biotinylated MHC complexes and 1 fluorophore molecule attached to the biotin binding pockets of streptavidin.

MHC complexes consisting of HLA-A*0201 heavy chain, beta2microglobulin and NLVPMVATV peptide (SEQ ID NO: 5914) or the negative control peptide GLAGDVSAV (SEQ ID NO: 5917) were generated as described elsewhere herein. The fluorophore in this example was Fluorescein-linker molecules as shown in FIG. 9. Each of these molecules consist of a linker-biotin molecule mounted with 4 trippel fluorescein-linker molecules. The linker-biotin molecule was here H-L30-Lys($NH_2$)-L30-Lys($NH_2$)-L30-Lys($NH_2$)L300Lys(caproylamidobiotin)-$NH_2$ where L30 was a 30 atom large linker and L300 was a 300 atom large linker. Both L30 and L300 was composed of multiple L15 linkers with the structure shown in FIG. 9B. Linker-biotin molecules were generated as follows: Downloaded Boc-L300-Lys(Fmoc) resin (100 mg) was deprotected and subjected to coupling with Boc-Lys(2CIZ)-OH, Boc-L30-OH, Boc-Lys(2CIZ)-OH, Boc-L30-OH, Boc-Lys (2CIZ)-OH then Boc-L30-OH. The resin was Fmoc deprotected and reacted twice (2×2 h) with caproylamido biotin NHS ester (25 mg in 0.5 mL NMP+25 microL DIPEA). The resin was washed with TFA and the product cleaved off with TFA:TFMSA:mCresol:thioanisol (6:2:1:1), 1 mL, precipitated with diethyl ether and purified by RP-HPLC. MS calculated for $C_{300}H_{544}N_{64}O_{137}S$ is 7272.009 Da, found 7271.19 Da.

Alternatively linker-biotin molecule was H-L60-Lys(NH$_2$)-L60-Lys(NH$_2$)-L60-Lys(NH$_2$)L300Lys(caproylamidobiotin)-NH$_2$ and made from downloaded Boc-L300-Lys(Fmoc) resin (100 mg), and then prepared analogously to H-L30-Lys(NH$_2$)-L30-Lys(NH$_2$)-L30-Lys(NH$_2$)L300Lys(caproylamidobiotin)-NH$_2$. MS calculated for C$_{360}$H$_{652}$N$_{76}$O$_{167}$S is 8749.5848 Da and was found to be 7271.19 Da. Yield 3 mg. The triple fluorescein-linker molecules was here betaalanin-L90-Lys(Flu)-L90-Lys(Flu)-L90-Lys(Flu)-NH$_2$ where Lys=Lysine, Flu=Fluorescein and L90 is a 90 atom linker (see FIG. 3 for further details). The triple-fluorescein-linker molecule was generated as follows: Downloaded Boc-Lys(Fmoc) resin, 2 g, was Boc deprotected and subjected to 3× coupling with Boc-L30-OH, Boc-Lys(Fmoc)-OH, 3×Boc-L30-OH, Boc-Lys(Fmoc)-OH, 3×Boc-L30-OH. The three Fmoc groups were removed and carboxyfluorescein, 301 mg, activated with HATU, 274 mg, and DIPEA, 139 µL, in 8 mL NMP, was added to the resin twice for 30 min. The resin was Boc deprotected and subjected to 2×30 min coupling with beta-alanine-N,N-diacetic acid benzyl ester, followed by 5 min treatment with 20% piperidine in NMP. The resin was washed with DCM, then TFA and the product was cleaved off the resin, precipitated with diethyl ether and purified by RP-HPLC. Yield was 621 mg. MS calculated for C268H402N44O116 is 6096.384 Da, while MS found was 6096 Da.

Biotin-linker molecule were coupled together with 4 triple fluorescein-linker molecules as follows: (500 nmol) was dissolved in 88 microliter NMP+2 µl pyridine and activated for 10 min at room temperature (conversion to cyclic anhydride) by addition of 10 µl N,N'diisopropylcarbodiimide. Following activation, the triple fluorescein-linker was precipitated with diethyl ether and redissolved in 100 microliter NMP containing 10 nmol biotin-linker. Once dissolved the coupling was initiated by addition of 5 µl diisopropyl ethyl amine, and was complete after 30 min.

Streptavidin and Fluorescein-linker molecules are then mixed in a molar ration of 1:1 and incubated for ½ hour. Then MHC complexes are added in 3-fold molar excess in respect to streptavidin and incubated for another ½ hour. Alternatively, MHC complexes are added first, then Fluorescein-linker molecules or MHC complexes are mixed with Fluorescein-linker molecules before addition to Streptavidin.

These MHC multimers are then used to stain CMV specific T cells in a flow Cytometry experiment. 1×10$^6$ purified HPBMC from a donor with T cells specific for HLA-A*0201(NLVPMVATV) (SEQ ID NO: 5914) are incubated with 10 µl of each of the two HLA-A*0201 (peptide)/Fluorescein constructs described above for 10 minutes in the dark at room temperature with a cell concentration of 2×10$^7$ cells/ml. 10 µl of mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are resuspended in 400-500 µl PBS; pH=7.2 and analysed on a flow cytometer.

In the above described example the Fluorescein-linker is as shown in FIG. 3 but the linker molecule can be any linker molecule such as those described in WO 2007/015168 A2 (Lohse (2007)) or alternatively chemical biotinylated fluorochrome can be used instead of Fluorescein-linker molecules. The MHC complexes described in this example is a MHC I molecule composed of HLA-A*0201 heavy chain, beta2microglobulin and NLVPMVATV (SEQ ID NO: 5914) peptide but can in principle be any MHC complex or MHC like molecule as described elsewhere herein.

Example 7

This is an example of how to make MHC multimers where the multimerization domain is dextran and the MHC complexes are chemically conjugated to the dextran multimerization domain.

MHC complexes consisting of HLA-A*0201 heavy chain, beta2microglobulin and NLVPMVATV (SEQ ID NO: 5914) peptide or the negative control peptide GLAGDVSAV (SEQ ID NO: 5917) are generated as described elsewhere herein. Dextran with a molecular weight of 270 kDa is activated with divinylsulfone. Activated Dextran is then incubated with MHC and RPE in a 0.05 M NaCHO$_3$ buffer; pH=9.5 with a molar ratio between MHC and Dextran of 30-60 and a molar ratio between RPE and dextran of 3-7:1 The mixture is placed in a water bath at 30° C. for 16 hours. Excess fluorochrome, MHC and dextran are removed by FPLC using a sephacryl S-300 column.

These MHC/RPE dextramers are then used to stain CMV specific T cells in a flow Cytometry experiment. Briefly, 1×10$^6$ purified HPBMC from a donor with T cells specific for HLA-A*0201(NLVPMVATV) (SEQ ID NO: 5914) are incubated with 10 µl of each of the two HLA-A*0201 (peptide)/RPE constructs described above for 10 minutes in the dark at room temperature with a cell concentration of 2×10$^7$ cells/ml. 10 µl mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analysed on a flow cytometer.

Example 8

This is an example of how to make MHC multimers where the multimerization domain is dextran and MHC complexes are MHC I molecules chemically conjugated to dextran multimerization domain and the dextran multimerization domain also have fluorochrome chemically coupled.

Human beta2microglobulin is coupled to dextran as follows. Dextran with a molecular weight of 270 kDa is activated with divinylsulfone. Activated dextran is incubated with human beta2microglobulin and RPE in a 0.05 M NaCHO$_3$ buffer; pH=9.5 with a molar ratio between beta2microglobulin and Dextran of 30-60 and a molar ratio between RPE and dextran of 3-7:1. The molar ratio of the final product is preferable 4-6 RPE and 15-24 beta2microglobulin per dextran. The mixture is placed in a water bath at 30° C. for 16 hours. Excess fluorochrome, beta2microglobulin and dextran are removed by FPLC using a sephacryl S-300 column. The beta2microglobulin-RPE-dextran construct is then refolded in vitro together with heavy chain and peptide using the following procedure. 200 ml refolding buffer (100 mM Tris, 400 mM L-arginin-HCL, 2 mM NaEDTA, 0.5 mM oxidized Gluthathione, 5 mM reduced Glutathione, pH 8.0) supplied with protease inhibitors PMSF, Pepstatin A and Leupeptin (to a final concentration of 1 mM, 1 mg/l and 1 mg/l, respectively) is made and cooled to 10° C. 12 mg NLVPMVATV (SEQ ID NO: 5914) peptide is dissolved in DMSO and added to the refolding buffer together with 20-30 mg beta2microglobulin-RPE-dex and 6 mg HLA-A*0201 heavy chain. Incubation at 10° C. for 4-8 hours, then 20-30 mg beta2microglobulin-RPE-dex and 6 mg HLA-A*0201 heavy chain is added and incubation continued for 4-8 hours. Another 20-30 mg beta2microglobulin-RPE-dex and 6 mg HLA-A*0201 heavy chain is added and incubation continued for 6-8 hours. The folding reaction is filtrated through a 0,2 μm filter to remove larger aggregates and then buffer exchanged into a buffer containing 20 mM Tris-HCl, 50 nM NaCl; pH=8.0 followed by concentration to 1-2 ml sample. Dextran-RPE-MHC complexes are then separated from excess heavy chain and peptide by size exclusion chromatography using a sephacryl S-300, S-400 or sephacryl S-500 column.

These MHC/RPE dextramers may be used to stain CMV specific T cells in a flow Cytometry experiment. Briefly, $1\times10^6$ purified HPBMC from a donor with T cells specific for HLA-A*0201(NLVPMVATV) (SEQ ID NO: 5914) are incubated with 10 μl of each of the two HLA-A*0201 (peptide)/RPE constructs described above for 10 minutes in the dark at room temperature with a cell concentration of $2\times10^7$ cells/ml. 10 μl of mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 μl PBS; pH=7.2 and analysed on a flow cytometer.

Example 9

This is an example of how to couple MHC-peptide complexes to a multimerization domain, where the multimerization domain is dextran.

This example describes how to couple an empty MHC or a MHC-complex to a dextran multimerization domain through a non-covalent coupling, to generate a MHC-dextramer. The MHC-dextramer in this example consisted of APC-streptavidin (APC-SA)-conjugated 270 kDA dextran and a biotinylated, folded MHC-complex composed of β2m, HLA-A*0201 heavy chain and either of the following peptides: YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), or KLAESIYKRL (SEQ ID NO: 5531) (derived from the *Borrelia*-specific antigen P37-42).

The APC-SA conjugated 270 kDA dextran contained 3,7 molecules of SA per dextran (each SA can bind 3 MHC-complexes) and the concentration was $16\times10^{-8}$ M. The concentration of the HLA-A*0201/peptide-complex was 4 mg/ml (1 μg=20,663 μmol). The molecular concentration of the MHC-complex was $8,27\times10^{-5}$M.

The MHC-complex was attached to the dextran by a non-covalent Biotin-Streptavidin interaction between the biotinylated Heavy Chain part of the MHC-complex and the SA, conjugated to dextran.

Here follows a protocol for how to produce 1000 μl of a MHC-dextramer solution with a final concentration of approximately $32\times10^{-9}$M:
1. 200 μL 270 kDA vinylsulfone-activated dextran, corresponding to $3,2\times10^{-11}$ mol, and 4 μl MHC-complex, corresponding to $3,55\times10^{-10}$ mol was mixed and incubated at room temperature in the dark for 30 min.
2. A buffer of 0,05M Tris-HCl, 15 mM NaN$_3$, 1% BSA, pH 7,2 was added to a total volume of 1000 μl.
3. The resulting MHC-dextramer preparation was used in flow cytometry experiments (see example AA7).

Example 10

This is an example of how to make and use MHC multimers that are trimers consisting of a streptavidin multimerization domain with 3 biotinylated MHC complexes and 1 fluorophore molecule attached to the biotin binding pockets of streptavidin.

MHC complexes consisting of HLA-A*0201 heavy chain, beta2microglobulin and either of the following peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), or KLAESIYKRL (SEQ ID NO: 5531) (derived from the *Borrelia*-specific antigen P37-42), or the negative control peptide ALIAPVHAV (SEQ ID NO: 5913) were generated as described elsewhere herein.

The fluorophore in this example was Fluorescein-linker molecules as shown in FIG. 3. Each of these molecules consist of a linker-biotin molecule mounted with 4 triple fluorescein-linker molecules. The linker-biotin molecule was here H-L30-Lys(NH$_2$)-L30-Lys(NH$_2$)-L30-Lys(NH$_2$) L300Lys(caproylamidobiotin)-NH$_2$ where L30 was a 30 atom large linker and L300 was a 300 atom large linker. Both L30 and L300 was composed of multiple L15 linkers with the structure shown in FIG. 3B. Linker-biotin molecules were generated as follows: Downloaded Boc-L300-Lys(Fmoc) resin (100 mg) was deprotected and subjected to coupling with Boc-Lys(2ClZ)-OH, Boc-L30-OH, Boc-Lys(2ClZ)-OH, Boc-L30-OH, Boc-Lys(2ClZ)-OH then Boc-L30-OH. The resin was Fmoc deprotected and reacted twice (2×2 h) with caproylamido biotin NHS ester (25 mg in 0.5 mL NMP+25 microL DIPEA). The resin was washed with TFA and the product cleaved off with TFA:TFMSA:m-Cresol:thioanisol (6:2:1:1), 1 mL, precipitated with diethyl ether and purified by RP-HPLC. MS calculated for C$_{300}$H$_{544}$N$_{64}$O$_{137}$S is 7272.009 Da, found 7271.19 Da.

Alternatively linker-biotin molecule was H-L60-Lys(NH$_2$)-L60-Lys(NH$_2$)-L60-Lys(NH$_2$)L300Lys(caproylamidobiotin)-NH$_2$ and made from downloaded Boc-L300-Lys (Fmoc) resin (100 mg), and then prepared analogously to H-L30-Lys(NH$_2$)-L30-Lys(NH$_2$)-L30-Lys(NH$_2$)L30OLys (caproylamidobiotin)-NH$_2$. MS calculated for C$_{360}$H$_{652}$N$_{76}$O$_{167}$S is 8749.5848 Da and was found to be 7271.19 Da. Yield 3 mg. The triple fluorescein-linker molecules was here betaalanin-L90-Lys(Flu)-L90-Lys(Flu)-L90-Lys(Flu)-NH$_2$ where Lys=Lysine, Flu=Fluorescein and L90 is a 90 atom linker (se FIG. 9 for further details). The triple-fluorescein-linker molecule was generated as follows: Downloaded Boc-Lys(Fmoc) resin, 2 g, was Boc deprotected and subjected to 3×coupling with Boc-L30-OH, Boc-Lys(Fmoc)-OH, 3×Boc-L30-OH, Boc-Lys(Fmoc)-OH, 3×Boc-L30-OH. The three Fmoc groups were removed and carboxyfluorescein, 301 mg, activated with HATU, 274 mg, and DIPEA, 139 µL, in 8 mL NMP, was added to the resin twice for 30 min. The resin was Boc deprotected and subjected to 2×30 min coupling with beta-alanine-N,N-diacetic acid benzyl ester, followed by 5 min treatment with 20% piperidine in NMP. The resin was washed with DCM, then TFA and the product was cleaved off the resin, precipitated with diethyl ether and purified by RP-HPLC. Yield was 621 mg. MS calculated for C268H402N44O116 is 6096.384 Da, while MS found was 6096 Da.

Biotin-linker molecule were coupled together with 4 triple fluorescein-linker molecules as follows: (500 nmol) was dissolved in 88 microliter NMP+2 µl pyridine and activated for 10 min at room temperature (conversion to cyclic anhydride) by addition of 10 µl N,N'diisopropylcarbodiimide. Following activation the triple fluorescein-linker was precipitated with diethyl ether and redissolved in 100 microliter NMP containing 10 nmol biotin-linker. Once dissolved the coupling was initiated by addition of 5 µl diisopropyl ethyl amine, and was complete after 30 min.

Streptavidin and Fluorescein-linker molecules are then mixed in a molar ration of 1:1 and incubated for ½ hour. Then MHC complexes are added in 3-fold molar excess in respect to streptavidin and incubated for another ½ hour. Alternatively, MHC complexes are added first, then Fluorescein-linker molecules or MHC complexes are mixed with Fluorescein-linker molecules before addition to Streptavidin.

These MHC multimers are then used to stain *Borrelia* specific T cells in a flow Cytometry experiment. 1×10$^6$ purified HPBMC from a donor with T cells specific for either of the following peptides: YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), or KLAESIYKRL (SEQ ID NO: 5531) (derived from the *Borrelia*-specific antigen P37-42), are incubated with 10 µl of each HLA-A*0201(peptide)/Fluorescein constructs described above for 10 minutes in the dark at room temperature with a cell concentration of 2×10$^7$ cells/ml. 10 µl of mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are resuspended in 400-500 µl PBS; pH=7.2 and analysed on a flow cytometer.

In the above described example, the Fluorescein-linker is as shown in FIG. 3 but the linker molecule can be any linker molecule for example as described in WO 2007/015168 A2 (Lohse (2007)) or alternatively chemical biotinylated fluorochrome can be used instead of Fluorescein-linker molecules. The MHC complexes described in this example is a MHC I molecule composed of HLA-A*0201 heavy chain, beta2microglobulin and either of the following peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), KLAESIYKRL (SEQ ID NO: 5531) (derived from the *Borrelia*-specific antigen P37-42), but can in principle be any MHC complex or MHC like molecule as described elsewhere herein.

Example 11

This is an example of how to make and use MHC multimers that are trimers. This is an example of how to make MHC multimers consisting of a streptavidin multimerization domain with 12 biotinylated MHC complexes attached to the biotin binding pockets of streptavidin and how to use such trimer MHC complexes to detect specific T cells by direct detection of individual cells in a flow cytometry experiment by addition of a biotinylated fluorophore molecule. In this example the fluorophore is Fluorescein linker molecules constructed as described elsewhere herein.

MHC complexes consisting of HLA-A*0201 heavy chain, beta2microglobulin and peptide are generated as described elsewhere. MHC complexes are incubated with streptavidin in a molar ratio of 3:1 for % hour.

These trimer MHC multimers are then used to stain *Borrelia* specific T cells in a flow Cytometry experiment. 1×10$^6$ purified HPBMC from a donor with T cells specific for either of the following peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-

42), and KLAESIYKRL (SEQ ID NO: 5531) (derived from the *Borrelia*-specific antigen P37-42) are incubated with 10 µl HLA-A*0201(peptide) multimer construct for 10 minutes in the dark at room temperature with a cell concentration of $2\times10^7$ cells/ml. Then Fluorescein linker molecules (as described in Example 9) are added and incubation continued for 5 minutes. 10 µl mouse-anti-human CD8/PB antibody (clone DK25 from Dako) is added and the incubation continued for another 20 minutes at 4° C. in the dark. The samples are then washed by addition of 2 ml PBS; pH=7.2 followed by centrifugation for 5 minutes at 200×g and the supernatant removed. Cells are resuspended in 400-500 µl PBS; pH=7.2 and analysed on a flow cytometer.

In this example the Fluorescein-linker is as shown in FIG. 3 but the linker molecule can be any linker molecule as described for example in WO 2007/015168 A2 or alternative chemically biotinylated fluorochrome may be used. The MHC complexes described in this example is a MHC I molecule composed of HLA-A*0201 heavy chain, beta2microglobulin either of the following peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42) but can in principle be any MHC complex or MHC like molecule as described elsewhere herein.

Example 12

This is an example of how to make MHC multimers where the multimerization domain is dextran and the MHC complexes are chemically conjugated to the dextran multimerization domain.

MHC complexes consisting of HLA-A*0201 heavy chain, beta2microglobulin either of the following peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), KLAESIYKRL (SEQ ID NO: 5531) (derived from the *Borrelia*-specific antigen P37-42), or the negative control peptide ALIAPVHAV (SEQ ID NO: 5913) are generated as described elsewhere herein. Dextran with a molecular weight of 270 kDa is activated with divinylsulfone. Activated Dextran is then incubated with MHC and RPE in a 0.05 M NaCHO$_3$ buffer; pH=9.5 with a molar ratio between MHC and Dextran of 30-60 and a molar ratio between RPE and dextran of 3-7:1 The mixture is placed in a water bath at 30° C. for 16 hours. Excess fluorochrome, MHC and dextran are removed by FPLC using a sephacryl S-300 column.

These MHC/RPE dextramers are then used to stain *Borrelia* specific T cells in a flow Cytometry experiment. Briefly, $1\times10^6$ purified HPBMC from a donor with T cells specific for either of the following peptides YLNTKSNG-NYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42) are incubated with 10 µl of each of the two HLA-A*0201(peptide)/RPE constructs described above for 10 minutes in the dark at room temperature with a cell concentration of $2\times10^7$ cells/ml. 10 µl mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analysed on a flow cytometer.

Example 13

This is an example of how to make MHC multimers where the multimerization domain is dextran and MHC complexes are MHC I molecules chemically conjugated to dextran multimerization domain and the dextran multimerization domain also have fluorochrome chemically coupled.

Human beta2microglobulin is coupled to dextran as follows. Dextran with a molecular weight of 270 kDa is activated with divinylsulfone. Activated dextran is incubated with human beta2microglobulin and RPE in a 0.05 M NaCHO$_3$ buffer; pH=9.5 with a molar ratio between beta2microglobulin and Dextran of 30-60 and a molar ratio between RPE and dextran of 3-7:1. The molar ratio of the final product is preferable 4-6 RPE and 15-24 beta2microglobulin per dextran. The mixture is placed in a water bath at 30° C. for 16 hours. Excess fluorochrome, beta2microglobulin and dextran are removed by FPLC using a sephacryl S-300 column. The beta2microglobulin-RPE-dextran construct is then refolded in vitro together with heavy chain and peptide using the following procedure. 200 ml refolding buffer (100 mM Tris, 400 mM L-arginin-HCL, 2 mM NaEDTA, 0.5 mM oxidized Gluthathione, 5 mM reduced Gluthathione, pH 8.0) supplied with protease inhibitors PMSF, Pepstatin A and Leupeptin (to a final concentration of 1 mM, 1 mg/l and 1 mg/l, respectively) is made and cooled to 10° C. 12 mg of either of the following peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42) is dissolved in DMSO and added to the refolding buffer together with 20-30 mg beta2microglobulin-RPE-dex and 6 mg HLA-A*0201 heavy chain. Incubation at 10° C. for 4-8 hours, then 20-30 mg beta2microglobulin-RPE-dex and 6 mg HLA-A*0201 heavy chain is added, and incubation continued for 4-8 hours. Another 20-30 mg beta2microglobulin-RPE-dex and 6 mg HLA-A*0201 heavy chain is added, and incubation continued for 6-8 hours. The folding reaction is filtrated through a 0,2 µm filter to remove larger aggregates and then buffer exchanged into a buffer containing 20 mM Tris-HCl, 50 nM NaCl; pH=8.0 followed by concentration to 1-2 ml sample. Dextran-RPE-MHC complexes are then separated from excess heavy chain and peptide by size exclusion chromatography using a sephacryl S-300, S-400 or sephacryl S-500 column.

These MHC/RPE dextramers may be used to stain *Borrelia* specific T cells in a flow Cytometry experiment. Briefly, 1×10$^6$ purified HPBMC from a donor with T cells specific for either of the following peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42) are incubated with 10 µl of each HLA-A*0201(peptide)/RPE constructs described above for 10 minutes in the dark at room temperature with a cell concentration of 2×10$^7$ cells/ml. 10 µl of mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 µl PBS; pH=7.2 and analysed on a flow cytometer.

Example 14

The preparation of a Pentamer is described in e.g. US 20040209295. Briefly, the following steps leads to a fluorescent Pentamer reagent:

The following is a detailed example for cloning, expressing, and purifying a pentameric class I MHC complex, which comprises a chimeric fusion of .beta.2m with COMP. The chimeric .beta.2m-COMP protein is expressed in insoluble inclusion bodies in *E. coli* and subsequently assembled as pentameric .beta.2m-COMP in vitro. The pentameric class I MHC peptide complex is then formed in a second refolding reaction by combining .beta.2m-COMP pentamers and the human MHC class I alpha. molecule known as HLA-A*0201, in the presence of an appropriate synthetic binding peptide representing the T cell antigen. In this example, a well characterized antigen derived from Epstein-Barr virus BMLF1 protein, GLCTLVAML (SEQ ID NO: 5915) (a.a. 289-297), is used. The resultant complex is labelled with a fluorescent entity and used as a staining reagent for detecting antigen-specific T cells from a mixed lymphocyte population, in a flow cytometry application.

The strategy involves the sequential cloning into pET-24c vector of .beta.2m, yielding a construct referred to as pETBMC01, followed by the insertion of the oligomerisation domain of cartilage oligomeric matrix protein (COMP) with a biotin acceptor sequence (BP) for site-specific biotinylation with the biotin-protein ligase BirA, yielding a construct referred to as pETBMC02. Thirdly a polyglycine linker is cloned in between .beta.2m and COMP, yielding a construct referred to as pETBMC03, and finally, a serine-residue is removed by site-directed mutagenesis, which serine residue precedes the poly-glycine linker, to give the final .beta.2m-COMP/pET-24c construct, referred to as pETBMC04.Removal of the serine residue is carried out to avoid steric hindrance when the .beta.2m molecule is associated with the MHC class I chain protein.

The extracellular portion of .beta.2 m comprises of 99 amino acids (equivalent to Ile1-Met99 of the mature protein) encoded by 74 bp-370 bp of the DNA sequence. This region of the .beta.2m sequence is amplified from a normal human lymphocyte cDNA library, by polymerase chain reaction (PCR)

beta.2m PCR product is purified from the above reaction mix using a QIAquick® PCR purification kit according to the manufacturer's instructions (Qiagen). 200 ng of purified PCR product and 1.mu.g pET-24c vector (Novagen) are each digested with BamH I (10 U) and Nde I (10 U) restriction enzymes (New England Biolabs, NEB) for 4 h at 37.degree. C., in accordance with the manufacturer's instructions, and purified. The gel-purified insert and vector DNA are ligated at a 1:3 molar ratio (vector:insert, 50 ng: 7.5 ng) using T4 DNA ligase (5 U; Bioline), in T4 DNA ligase buffer (as supplied) for 16 hrs at 16.degree. C.

The ligation mixtures and appropriate controls are subsequently transformed into XL1-Blue strain competent *E. coli* cells, according to the manufacturer's instructions (Stratagene). Successful transformants are selected by plating the cells on Luria-Bertani (LB) agar plates containing 30.mu.g/ml kanamycin, and incubating overnight at 37.degree. C.

A selection of single colonies from the bacterial transformation plates are screened by PCR with T7 promoter (1.mu.M) and T7 terminator (1.mu.M) primers (Sigma Genosys, see Appendix I for primer sequences), which are complementary to regions of the pET vector flanking the cloning site. Amplification is carried out using Taq DNA polymerase (1 U, Bioline) in Taq reaction buffer (as supplied), supplemented with 2 mM MgSO.sub.4 and 0.2 mM dNTPs, using 25 thermal-cycling reactions as detailed above. Successful transformants generated a DNA fragment of approximately 500 bp, ascertained by 1.5% agarose gel electrophoresis.

Bacterial transformants that generated the correct size of PCR products are inoculated into 6 ml of sterile LB-kanamycin medium and incubated overnight at 37.degree. C. with 200 rpm shaking. pETBMC01 plasmid DNA is recovered from the bacterial cultures using a QIAprep® Spin Mini-prep kit according to the manufacturer's instructions (Qiagen). The presence of the .beta.2m fragment in these plasmids is further verified by automated DNA sequencing.

The sequence of the oligomerisation domain of COMP is obtained from the Genbank database (accession #1705995) and a region encoding the coiled-coil domain (amino acids 21-85) is selected based on self-association experiments of COMP (Efinov et al., FEBS Letters 341:54-58 (1994)). A biotin acceptor sequence 'BP': SLNDIFEAQKIEWHE (SEQ ID NO: 5918) is incorporated at the C terminus and an additional 14 amino acid linker, PQPQPKPQPKPEPET (SEQ ID NO: 5919) is included to provide a physical separation between the COMP oligomerising domain and BP.

The whole region is synthesized using the overlapping complementary oligonucleotides, and purified COMP-BP and 1.mu.g pETBMC01 vector are digested for 4 hrs at 37.degree. C. using Hind III (10 U) and Xho I (10 U) restriction enzymes (NEB), as described in Section 1.1. The digestion products are purified, ligated, transformed and PCR screened as in Section 1.1. Plasmids positive from the screen are purified and sequenced as described in Section 1.1.

The poly-glycine linker is synthesized by annealing overlapping oligonucleotides. Since the nucleotide sequence of the polyGlycine linker only incorporates the 5' overhang of the cut BamH I restriction site, and the 3' overhang of the cut Hind III nucleotide recognition motifs, there is no need to digest the annealed product to produce the complementary single-stranded overhangs suitable for subsequent ligation. The oligonucleotides are phosphorylated and annealed as described in Section 1.2.

pETBMC02 is digested with BamH I (10 U) and Hind III (10 U). Ligation of the annealed poly-glycine linker into pETBMCO2 was as described previously (Section 1.1), assuming 96 fmoles of annealed oligonucleotide/.mu.l. The transformation and PCR-screening reactions are as described in Section 1.1, but in addition, the presence of an inserted linker is verified by a restriction enzyme digestion of the PCR screen product to ascertain the presence or absence of a Sal I restriction site. Successful transformants are not susceptible to Sal I digestion, given the removal of the site from the plasmid vector backbone. Purification of pETBMC03 and automated sequencing is as described in Section 1.1.

Analysis of X-ray crystallography models of MHC class I molecules reveal that the C terminus of .beta.2m closely abuts the .alpha.3 domain of the alpha. chain. It is therefore desirable to achieve maximum flexibility at the start of the poly-glycine linker.

The extracellular portion of HLA-A*0201 alpha. chain (EMBL M84379) comprises of 276 amino acids (equivalent to Gly1-Pro276 of the mature protein) encoded by bases 73-900 of the messenger RNA sequence. This region of the A*0201 sequence is amplified from a normal human lymphocyte cDNA library by PCR, using the primers A2S #1 and A2S #2 which incorporated NcoI and BamHI restriction sites respectively. The procedure for cloning the A*0201 insert into Nco I/BamH I-digested pET-11d vector (Novagen) is essentially as described for .beta.2m in Section 1.1.

An identical procedure is carried out to produce either .beta.2m-COMP or A*0201 alpha. chain proteins. Plasmid DNA is transformed into an E. coli expression host strain in preparation for a large scale bacterial prep. Protein is produced as insoluble inclusion bodies within the bacterial cells, and is recovered by sonication. Purified inclusion bodies are solubilised in denaturing buffer and stored at −80.degree. C. until required.

Purified plasmid DNA is transformed into the BL21(DE3) pLysS E. coli strain, which carries a chromosomal copy of the T7 RNA polymerase required to drive protein expression from pET-based constructs. Transformations into BL21 (DE3)pLysS competent cells (Stratagene) are carried out with appropriate controls.

A single bacterial transformant colony is inoculated into 60 ml sterile LB medium, containing appropriate antibiotics for selection, and left to stand overnight in a warm room (.about.24.degree. C.) The resulting overnight culture is added to 6 litres of LB and grown at 37.degree. C. with shaking (.about.240 rpm), up to mid-log phase (OD-.sub.600=0.3-0.4). Protein expression is induced at this stage by addition of 1.0 ml of 1M IPTG to each flask. The cultures are left for a further 4 h at 37.degree. C. with shaking, after which the cells are harvested by centrifugation and the supernatant discarded.

The bacterial cell pellet is resuspended in ice-cold balanced salt solution and sonicated (XL series sonicator; Misonix Inc., USA) in a small glass beaker on ice in order to lyse the cells and release the protein inclusion bodies. Once the cells are completely lysed the inclusion bodies are spun down in 50 ml polycarbonate Oak Ridge centrifuge tubes in a Beckman high-speed centrifuge (J2 series) at 15,000 rpm for 10 min. The inclusion bodies are then washed three times in chilled Triton® wash This is followed by a final wash in detergent-free wash buffer.

The resultant purified protein preparation is solubilised in 20-50 ml of 8 M urea buffer, containing 50 mM MES, pH 6.5, 0.1 mM EDTA and 1 mM DTT, and left on an end-over-end rotator overnight at 4.degree. C. Insoluble particles are removed by centrifugation and the protein yield is determined using Bradford's protein assay reagent (Bio-Rad Laboratories) and by comparison with known standards. Urea-solubilised protein is dispensed in 10 mg aliquots and stored at −80.degree. C. for future use.

Assembly of .beta.2m-COMP from the urea-solubilised inclusion bodies is performed by diluting the protein into 20 mM CAPS buffer, pH 11.0, containing 0.2 M sodium chloride and 1 mM EDTA, to give a final protein concentration of 1.5 mg/ml. The protein is oxidised at room temperature by addition of oxidised and reduced glutathione to final concentrations of 20 mM and 2 mM, respectively. Following an overnight incubation, disulphide bond formation is analysed by non-reducing SDS-PAGE on 10% bis-tricine gels (Invitrogen).

The protein mixture is subsequently buffer exchanged into 20 mM Tris, pH 8.0, 50 mM sodium chloride ('S200 buffer'), and concentrated to a final volume of 4.5 ml, in preparation for enzymatic biotinylation with BirA (Affinity, Denver, Colo.). 0.5 ml of 10.times. BirA reaction buffer (as supplied) is added, and recombinant BirA enzyme at 10.mu.M final concentration, supplemented with 10 mM ATP, pH 7.0. A selection of protease inhibitors is also used to preserve the proteins: 0.2 mM PMSF, 2.mu.g/ml pepstatin and 2.mu.g/ml leupeptin. The reaction is left for 4 hours at room temperature.

Biotinylated .beta.2m-COMP is purified by size exclusion chromatography (SEC) on a Superdex®200 HR 26/60 column (Amersham Biosciences), running S200 buffer.

500 ml of refolding buffer is prepared as follows: 100 mM Tris, pH 8.0, 400 mM Larginine hydrochloride, 2 mM EDTA, 5 mM reduced glutathione and 0.5 mM oxidised glutathione, dissolved in deionised water and left stirring at 4.degree. C. 15 mg of lyophilised synthetic peptide GLCTLVAML (SEQ ID NO: 5915) is dissolved in 0.5 ml dimethylsulfoxide and added to the refolding buffer whilst stirring. 50 mg of biotinylated pentameric .beta.2m-COMP and 30 mg of A*0201 alpha. chain is added sequentially, injected through a 23 gauge hypodermic needle directly into the vigorously-stirred buffer, to ensure adequate dispersion. The refolding mixture is then left stirring gently for 16 hours at 4.degree. C.

The protein refolding mixture is subsequently concentrated from 500 ml to 20 ml using a MiniKros hollow fibre ultrafiltration cartridge (Spectrum Labs, Rancho Dominguez, Calif.) with a 30 kD molecular weight cutoff. Further concentration of the complex from 20 ml to 5 ml is carried out in Centricon Plus-20 centrifugal concentrators (30 kD molecular weight cut-off) according to the manufacturer's instructions, followed by buffer exchange into S200 buffer using disposable PD10 desalting columns (Amersham Biosciences), according to the manufacturer's instructions. Final volume is 7.5 ml. The concentrated protein refold mixture is first purified by SEC on a Superdex® 200 HR 26/60 gel filtration chromatography column, as in Section 4.2. Fractions containing protein complexes in the region of 310 kD is collected.

Fractions collected from SEC are pooled and subjected to further purification by anion exchange chromatography on a MonoQ® HR 5/5 column (Amersham Biosciences), running a salt gradient from 0-0.5 M sodium chloride in 20 mM Tris over 15 column volumes. The dominant peak is collected. Protein recovery is determined using the Bradford assay.

Since each streptavidin molecule is able to bind up to 4 biotin entities, final labelling with phycoerythrin (PE)-conjugated streptavidin is carried out in a molar ratio of 1:0.8, streptavidin to biotinylated pentamer complex respectively, taking into account the initial biotinylation efficiency measurement made for .beta.2m-COMP in Section 4.2. The total required amount of pentamer complex is subdivided (e.g. into 5 equal amounts) and titrated successively into streptavidin-PE. The concentration of A*0201 pentamer-streptavidin complex is adjusted to 1 mg/ml with phosphate buffered saline (PBS), supplemented with 0.01% azide and 1% BSA. This resultant fluorescent Pentamer reagent is stored at 4.degree. C.

Example 16

Prediction of Binding Peptides (Antigenic Peptides, P)

Amino acid sequences of *Borrelia* proteins OppA, DbpA, FlhF, FlaB and P37-42 from different strains and species were retrieved from the NCBI protein database (http://www.ncbi.nlm.nih.gov). Binding peptides were generated by computational prediction using the prediction software, NetMHC (http://www.cbs.dtu.dk/services/NetMHC/). Prediction was carried out using an affinity threshold of 1000 nM for the top 20 most frequent HLA class 1 alleles in the Caucasian population (A0101, A0201, A0301, A1101, A2402, A2501, A2601, A2902, A3101, A3201, A6801, B0702, B0801, B1503, B1801, B3501, B4002, B4402, B4501, B5101). The purpose of the prediction software was to identify at least all strong and weak 9-, 10-, 11-, and 12-mer peptide binders of the 20 HLA class 1 alleles. The MHC class 1 alleles for which no binders were predicted and/or for which the affinity exceed the cut off value at 1000 nM were omitted. Strong binders were defined as binders with an affinity less than 50 nM and weak binders with a value of less than 500 nM. Peptides with an affinity below 1000 nm were transferred to an excel spreadsheet. Here, peptides were listed according to length and HLA-allele. Duplicate/repeat peptides that were predicted more than once in the different species and strains for the same antigen were removed, whereas potential duplicates/repeats between HLA-alleles were preserved. The results can be seen in Tables A-E.

Example 17

Prediction of OppA Binding Peptides:

This example describes the directed approach to predict OppA peptide sequences that bind to MHC class 1 molecules, applied to known protein sequences; the *Borrelia* protein OppA. Specifically, the OppA protein encoded by the species *Borrelia afzelii* (strains ACA-1, PKO and HLJ01; SEQ ID Nos:1-3), *Borrelia Garinii* (strains PBI, PBR and NMJW1; SEQ ID Nos:4-6) and *Borrelia burgdorferi* (strains JD1, LF7A and ZS7; SEQ ID Nos:7-9) were included in the prediction of OppA binding peptides.

Prediction was carried out using the known preferences of the top 20 most common HLA class 1 alleles using NetMHC database (http://www.cbs.dtu.dk/services/NetMHC/). With the result of the prediction software, we identified all strong and weak 9-, 10-, 11-, and 12-mer peptide binders for each OppA protein (SEQ ID Nos:1-9). Duplicate/repeat peptides that were predicted more than once between any one of SEQ ID Nos:1-9 were removed, and hence the binding peptides listed for each allele includes peptides predicted for at least one of OppA SEQ ID Nos:1-9. The predicted peptides for each of the 20 alleles with an affinity below 1000 nm were listed according to peptide length. The result can be seen in Table A.

Example 18

Prediction of DbpA Binding Peptides:

This example describes the directed approach to predict DbpA peptide sequences that bind to MHC class 1 molecules, applied to known protein sequences; the *Borrelia* protein DbpA. Specifically, the DbpA protein encoded by the species *Borrelia afzelii* (strains PKO, ACA-1, A91 and U01; SEQ ID Nos:10-13), *Borrelia Garinii* (strains PBI, PREF, VS461 AND S40; SEQ ID Nos:14-17) and *Borrelia burgdorferi* (strains B31, PMAI and CA-11.2A; SEQ ID Nos:18-20) were included in the prediction of DbpA binding peptides.

Prediction was carried out using the known preferences of the top 20 most common HLA class 1 alleles using NetMHC database (http://www.cbs.dtu.dk/services/NetMHC/). With the result of the prediction software, we identified all strong and weak 9-, 10-, 11-, and 12-mer peptide binders for each DbpA protein (SEQ ID Nos:10-20). Duplicate/repeat peptides that were predicted more than once between any one of SEQ ID Nos:10-20 were removed, and hence the binding peptides listed for each allele includes peptides predicted for at least one of DbpA SEQ ID Nos:10-20. The predicted peptides for each of the 20 alleles with an affinity below 1000 nm were listed according to peptide length. The result can be seen in Table B.

No binding peptides were predicted for HLA-B*5101 and this allele is therefore omitted.

Example 19

Prediction of Flhf Binding Peptides:

This example describes the directed approach to predict Flhf peptide sequences that bind to MHC class 1 molecules, applied to known protein sequences; the *Borrelia* protein Flhf. Specifically, the Flhf protein encoded by the species *Borrelia afzelii* (strains ACA-1 and PKO; SEQ ID Nos:21-22), *Borrelia Garinii* (strains FAR04, PBI and PBR; SEQ ID Nos:23-25) and *Borrelia burgdorferi* (strains B31, N40 and ZS7; SEQ ID Nos:26-28) were included in the prediction of Flhf binding peptides.

Prediction was carried out using the known preferences of the top 20 most common HLA class 1 alleles using NetMHC database (http://www.cbs.dtu.dk/services/NetMHC/). With the result of the prediction software, we identified all strong and weak 9-, 10-, 11-, and 12-mer peptide binders for each Flhf protein (SEQ ID Nos:21-28). Duplicate/repeat peptides that were predicted more than once between any one of SEQ ID Nos:21-28 are removed, and hence the binding peptides listed for each allele includes peptides predicted for at least one of Flhf SEQ ID Nos:21-28. The predicted peptides for each of the 20 alleles with an affinity below 1000 nm were listed according to peptide length. The result can be seen in Table C.

Example 20

Prediction of FlaB Binding Peptides:

This example describes the directed approach to predict FlaB peptide sequences that bind to MHC class 1 molecules, applied to known protein sequences; the *Borrelia* protein FlaB. Specifically, the FlaB protein encoded by the species *Borrelia afzelii* (strains PKO, 9W10-04, P-GAU and VS461; SEQ ID Nos:29-32), *Borrelia Garinii* (strains PBI, BGVIR and 20047; SEQ ID Nos:33-35) and *Borrelia burgdorferi* (strains A1 and CA8; SEQ ID Nos:36-37) were included in the prediction of FlaB binding peptides.

Prediction was carried out using the known preferences of the top 20 most common HLA class 1 alleles using NetMHC database (http://www.cbs.dtu.dk/services/NetMHC/). With the result of the prediction software, we identified all strong and weak 9-, 10-, 11-, and 12-mer peptide binders for each FlaB protein (SEQ ID Nos:29-37). Duplicate/repeat peptides that were predicted more than once between any one of SEQ ID Nos:29-37 were removed, and hence the binding peptides listed for each allele includes peptides predicted for at least one of FlaB SEQ ID Nos:29-37. The predicted peptides for each of the 20 alleles with an affinity below 1000 nm were listed according to peptide length. The result can be seen in Table D.

Example 21

Prediction of P37-42 Binding Peptides:

This example describes the directed approach to predict P37-42 peptide sequences that bind to MHC class 1 molecules, applied to known protein sequences; the *Borrelia* protein P37-42. Specifically, the P37-42 protein encoded by the species *Borrelia Garinii* (strains noname; SEQ ID Nos: 38) and *Borrelia burgdorferi* (strains noname; SEQ ID Nos:39) were included in the prediction of P37-42 binding peptides.

Prediction was carried out using the known preferences of the top 20 most common HLA class 1 alleles using NetMHC database (http://www.cbs.dtu.dk/services/NetMHC/). With the result of the prediction software, we identified all strong and weak 9-, 10-, 11-, and 12-mer peptide binders for each P37-42 protein (SEQ ID Nos:38-39). Duplicate/repeat peptides that were predicted more than once between any one of SEQ ID Nos:38-39 are removed, and hence the binding peptides listed for each allele includes peptides predicted for at least one of P37-42 SEQ ID Nos:38-39. The predicted peptides for each of the 20 alleles with an affinity below 1000 nm were listed according to peptide length. The result can be seen in Table E.

Example 22

Test of Predicted DbpA, OppA, Flhf, FlaB, and P37-42 9-12 Mer Binding Peptide Functionality in ELISPOT In examples 17-21 above 9-12 mer binding peptides derived from DbpA, OppA, Flhf, FlaB, and P37-42 for HLA-A*0201 were identified as YLNTKSNGNYEI (SEQ ID NO: 359) (OppA), FLSIFTQGYT (SEQ ID NO: 241) (OppA), GIYDLILNA (SEQ ID NO: 2761) (DbpA), YIKDINEFI (SEQ ID NO: 4479) (Flhf), IQIEIEQLTDEI (SEQ ID NO: 5126) (FlaB), RMISDQRANLGA (SEQ ID NO: 5127) (FlaB), SQGGVNSPV (SEQ ID NO: 5112) (FlaB), MLDEAKDKL (SEQ ID NO: 5516) (P37-42), FMEQATNSWI (SEQ ID NO: 5530) (P37-42), NLVFSSLFL (SEQ ID NO: 5510) (P37-42) and KLAESIYKRL (SEQ ID NO: 5531) (P37-42). These peptides can be tested in ELISPOT to see if they are able to detect the presence of DbpA, OppA, Flhf, FlaB, and P37-42-specific CD8 positive T cells in PBL (Peripheral Blood Lymphocytes) from a breast cancer patient. PBL from a breast cancer patient is analysed by ELISPOT ex vivo either with or without the abovementioned peptides, 106 PBL/well in doublets. The number of spots is counted using the Immunospot Series 2.0 Analyzer (CTL Analysers). The results will show the presence of DbpA, OppA, Flhf, FlaB, and P37-42-specific T-cells and thereby the functionality of the peptides as compared to the absence of added peptide. *This example is inspired from Cancer Immunol Immunother Apr; 56(4)527-33.*

Example 23

Use of DbpA, OppA, Flhf, FlaB, and P37-42 Specific MHC Dextramer for Sorting of Antigen-Specific CD8 T Cells from Patient Sample In examples 17-21 binding peptides from DbpA, OppA, Flhf, FlaB, and P37-42 9-12 for HLA-A*0201 were identified as

```
                                    (SEQ ID NO: 359)
            YLNTKSNGNYEI (OppA), (SEQ ID NO: 241)
            FLSIFTQGYT (OppA), (SEQ ID NO: 2761)
            GIYDLILNA (DbpA), (SEQ ID NO: 4479)
            YIKDINEFI (Flhf),
```

-continued

IQIEIEQLTDEI (FlaB), (SEQ ID NO: 5126)

RMISDQRANLGA (FlaB), (SEQ ID NO: 5127)

SQGGVNSPV (FlaB), (SEQ ID NO: 5112)

MLDEAKDKL (P37-42), (SEQ ID NO: 5516)

FMEQATNSWI (P37-42), (SEQ ID NO: 5530)

NLVFSSLFL (P37-42), (SEQ ID NO: 5510)
and

KLAESIYKRL (P37-42). (SEQ ID NO: 5531)

In the present example we show how MHC multimers displaying the selected peptides can be used to sort Borrelia-specific T cells from a blood sample from a patient infected with Borrelia. The sample is analysed ex vivo with MHC Dextramer displaying the predicted epitopes in the context of HLA-A*0201 (HLA-A*0201/YLNTKSNGNYEI (OppA), (SEQ ID NO: 359)

HLA-A*0201/FLSIFTQGYT (OppA), (SEQ ID NO: 241)

HLA-A*0201/GIYDLILNA (DbpA), (SEQ ID NO: 2761)

HLA-A*0201/YIKDINEFI (Flhf), (SEQ ID NO: 4479)

HLA-A*0201/IQIEIEQLTDEI (FlaB), (SEQ ID NO: 5126)

HLA-A*0201/RMISDQRANLGA (FlaB), (SEQ ID NO: 5127)

HLA-A*0201/SQGGVNSPV (FlaB), (SEQ ID NO: 5112)

HLA-A*0201/MLDEAKDKL (P37-42), (SEQ ID NO: 5516)

HLA-A*0201/FMEQATNSWI (P37-42), (SEQ ID NO: 5530)

HLA-A*0201/NLVFSSLFL (P37-42), (SEQ ID NO: 5510)
and

HLA-A*0201/KLAESIYKRL (P37-42) (SEQ ID NO: 5531)

by flow cytometry to identify DbpA, OppA, Flhf, FlaB, and P37-42-specific CD8 T cells. The antigen-specific CD8 positive T-cells are then sorted out during using flow cytometry sorting. The detectable population of dextramer positive CD8 T cells is sorted as single cells into 96 well plates using the following protocol:

Small lymphocytes are gated by forward and side scatter profile, before cloning according to CD8/MHC-multimer double staining. CD8/MHC-multimer double-positive cells are sorted as single cells into 96 well plates (Nunc) already containing $10^5$ cloning mix cells/well. The cloning mix is prepared containing $10^6$ irradiated (20 Gy) lymphocytes from three healthy donors per ml in X-vivo with 5% heat-inactivated human serum, 25 mM HEPES buffer (GibcoBRL), 1 µg/ml phytohemagglutinin (PHA) (Peprotech) and 120 U/ml IL-2. The cloning mix is incubated for two hours at 37° C./5% $CO_2$, prior to cloning. After cloning, the plates are incubated at 37° C./5% $CO_2$. Every 3-4 days 50 µl fresh media are added containing IL-2 to a final concentration of 120 U/ml. Following 10-14 days of incubation, growing clones are further expanded using cloning mix cells. Consequently, each of the growing clones are transferred (split) into two or three wells (depending on the number of growing cells) of a new 96 well plate containing $5 \times 10^4$ cloning mix cells/well. Clones that are not growing at this time are incubated for another week with IL-2, and then expanded. Subsequently, the specificity of the growing clones is tested in a $^{51}$Cr-release assay or by FACS. *This example is inspired from Cancer Immunol Immunother Apr; 56(4)527-33.*

Example 24

Synthesis of a Comprehensive Library of Antigenic Peptides of Variable Size Derived from a Full-Length Antigen Sequence.

In this example it is described how virtually all of the possible 8'- to 14'-mer peptide epitopes of an antigen may be synthetically prepared by modification of the standard Fmoc peptide synthesis protocol.

N-(-amino acids are incorporated into a peptide of the desired sequence with one end of the sequence remaining attached to a solid support matrix. All soluble reagents can be removed from the peptide-solid support matrix by filtration and washed away at the end of each coupling step. After each of the coupling steps, and after the removal of reagents, a fraction of the generated peptides are removed and recovered from the polymeric support by cleavage of the cleavable linker that links the growing peptide to solid support.

The solid support can be a synthetic polymer that bears reactive groups such as —OH. These groups are made so that they can react easily with the carboxyl group of an N-(-protected amino acid, thereby covalently binding it to the polymer. The amino protecting group can then be removed and a second N-(-protected amino acid can be coupled to the attached amino acid. These steps are repeated until the desired sequence is obtained. At the end of the synthesis, a different reagent is applied to cleave the bond between the C-terminal amino acid and the polymer support; the peptide then goes into solution and can be obtained from the solution.

Initially, the first Fmoc amino acid (starting at the C-terminal end of the antigen sequence) is coupled to a precursor molecule on an insoluble support resin via an acid labile linker. Deprotection of Fmoc is accomplished by treatment of the amino acid with a base, usually piperidine. Before coupling the next amino acid, a fraction of the synthesized peptide (for example 0.1%) is detached from the solid support, and recovered. Then additional beads carrying only the precursor molecule including the linker (for example corresponding to 0.1% of the total amount of solid support in the reaction) is added. Then the next Fmoc amino acid is coupled utilizing a pre-activated species or in situ activation.

This cycle of amino acid coupling, removal of reagents, detachment of a small fraction of synthesized peptide and recovery of these, and activation of the immobilized peptide to prepare for the next round of coupling, goes on until the entire antigen sequence has been processed.

The recovered peptides thus represent different fragments of the antigen, with varying lengths. The peptide pool thus contains most or all of the possible peptide epitopes of the antigen and may be used in the preparation of MHC multimers as a pool.

The entire process, including the detachment of a fraction of the peptides after each round of coupling, follows standard Fmoc peptide synthesis protocols, and involves weak acids such as TFA or TMSBr, typical scavengers such as thiol compounds, phenol and water, and involves standard protecting groups.

Example 25

This is an example of how MHC multimers may be used for diagnosis of Lyme Disease in blood samples from humans infected with *Borrelia* bacteria.

In this example the MHC multimer used are MHC complexes coupled to fluorophor-labelled dextran (Dextramers). The dextramers are used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0201 heavy chain, human beta2microglobulin and a peptide derived from *Borrelia* antigens OppA (Table A), DbpA (Table B), Flhf (Table C), FlaB (Table D) and P37-42 (Table E) from the three species *Borrelia Burgdorferi, Borrelia Garinii* and *Borrelia Afzelii*, or a negative control peptide, are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8×10e-8 M.

The following MHC(peptide)/APC dextran constructs are made:

1. APC-SA conjugated 270 kDa dextran coupled with HLA-A*0201 in complex with beta2microglobulin and the peptide YLNTKSNGNYEI (SEQ ID NO: 359) derived from the antigen OppA.
2. APC-SA conjugated 270 kDa dextran coupled with HLA-A*0201 in complex with beta2microglobulin and the peptide FLSIFTQGYT (SEQ ID NO: 241) derived from the antigen OppA.
3. APC-SA conjugated 270 kDa dextran coupled with HLA-A*0201 in complex with beta2microglobulin and the peptide GIYDLILNA (SEQ ID NO: 2761) derived from the antigen DbpA.
4. APC-SA conjugated 270 kDa dextran coupled with HLA-A*0201 in complex with beta2microglobulin and the peptide YIKDINEFI (SEQ ID NO: 4479) derived from the antigen Flhf.
5. APC-SA conjugated 270 kDa dextran coupled with HLA-A*0201 in complex with beta2microglobulin and the peptide IQIEIEQLTDEI (SEQ ID NO: 5126) derived from the antigen FlaB.
6. APC-SA conjugated 270 kDa dextran coupled with HLA-A*0201 in complex with beta2microglobulin and the peptide RMISDQRANLGA (SEQ ID NO: 5127) derived from the antigen FlaB.
7. APC-SA conjugated 270 kDa dextran coupled with HLA-A*0201 in complex with beta2microglobulin and the peptide SQGGVNSPV (SEQ ID NO: 5112) derived from the antigen FlaB.
8. APC-SA conjugated 270 kDa dextran coupled with HLA-A*0201 in complex with beta2microglobulin and the peptide MLDEAKDKL (SEQ ID NO: 5516) derived from the antigen P37-42.
9. APC-SA conjugated 270 kDa dextran coupled with HLA-A*0201 in complex with beta2microglobulin and the peptide FMEQATNSWI (SEQ ID NO: 5530) derived from the antigen P37-42.
10. APC-SA conjugated 270 kDa dextran coupled with HLA-A*0201 in complex with beta2microglobulin and the peptide NLVFSSLFL (SEQ ID NO: 5510) derived from the antigen P37-42.
11. APC-SA conjugated 270 kDa dextran coupled with HLA-A*0201 in complex with beta2microglobulin and the peptide KLAESIYKRL (SEQ ID NO: 5531) derived from the antigen P37-42.
12. APC-SA conjugated 270 kDa dextran coupled with HLA-A*0201 in complex with beta2microglobulin and the nonsense peptide ALIAPVHAV (SEQ ID NO: 5913).

The binding of the above described MHC(peptide)/APC dextran is used to determine the presence of DbpA-, OppA-, Flhf-, FlaB-, and P37-42-specific T cells in the blood from *Borrelia* infected individuals by flow cytometry following a standard flow cytometry protocol.

Blood from a patient with Lyme disease is isolated and 100 ul of this blood is incubated with 10 µl of each of the MHC(peptide)/APC dextran constructs described above for 10 minutes in the dark at room temperature. 5 µl of each of each of the antibodies mouse-anti-human CD3/PB (clone UCHT1 from Dako), mouse-anti-human CD4/FITC (clone MT310 from Dako) and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated twice. The washed cells are resuspended in 400-500 µl PBS+1% BSA; pH=7.2 and analysed on a flow cytometer.

The presence of cells labelled with anti-CD3/PB, anti-CD8/PE and the MHC(peptide)/APC dextran constructs described above identify the presence of *Borrelia* specific T cells and indicate that the patient are infected with *Borrelia* bacteria. Blood analysed with MHC(peptide)/APC dextran construct 12 can be used as negative control. The sensitivity of the above described diagnostic test may be enhanced by addition of labelled antibodies specific for activation markers expressed in or on the surface of the *Borrelia* specific T cells.

We conclude that the MHC(peptide)/APC dextran constructs can be used to detect the presence of *Borrelia* specific T cells in the blood of patients infected with *Borrelia*.

Example 26

This study shows how a panel of *Borrelia*-specific Dextramers can identify *Borrelia*-specific T cells in blood samples from patients and hence the potential of using measurement of *Borrelia*-specific T cells as a diagnostic relevant biomarker has been investigated.

The following *Borrelia*-specific MHC Dextramer constructs and controls were made for the panel:
 1. Fluorochrome and SA conjugated 270 kDa dextran coupled with HLA-A*0201 in complex with beta2microglobulin and the peptide YLNTKSNGNYEI (SEQ ID NO: 359) derived from the antigen OppA.
 2. Fluorochrome and SA conjugated 270 kDa dextran coupled with HLA-A*0201 in complex with beta2microglobulin and the peptide FLSIFTQGYT (SEQ ID NO: 241) derived from the antigen OppA.
 3. Fluorochrome and SA conjugated 270 kDa dextran coupled with HLA-A*0201 in complex with beta2microglobulin and the peptide GIYDLILNA (SEQ ID NO: 2761) derived from the antigen DbpA.
 4. Fluorochrome and SA conjugated 270 kDa dextran coupled with HLA-A*0201 in complex with beta2microglobulin and the peptide YIKDINEFI (SEQ ID NO: 4479) derived from the antigen Flhf.
 5. Fluorochrome and SA conjugated 270 kDa dextran coupled with HLA-A*0201 in complex with beta2microglobulin and the peptide IQIEIEQLTDEI (SEQ ID NO: 5126) derived from the antigen FlaB.
 6. Fluorochrome and SA conjugated 270 kDa dextran coupled with HLA-A*0201 in complex with beta2microglobulin and the peptide RMISDQRANLGA (SEQ ID NO: 5127) derived from the antigen FlaB.
 7. Fluorochrome and SA conjugated 270 kDa dextran coupled with HLA-A*0201 in complex with beta2microglobulin and the peptide SQGGVNSPV (SEQ ID NO: 5112) derived from the antigen FlaB.
 8. Fluorochrome and SA conjugated 270 kDa dextran coupled with HLA-A*0201 in complex with beta2microglobulin and the peptide MLDEAKDKL (SEQ ID NO: 5516) derived from the antigen P37-42.
 9. Fluorochrome and SA conjugated 270 kDa dextran coupled with HLA-A*0201 in complex with beta2microglobulin and the peptide FMEQATNSWI (SEQ ID NO: 5530) derived from the antigen P37-42.
 10. Fluorochrome and SA conjugated 270 kDa dextran coupled with HLA-A*0201 in complex with beta2microglobulin and the peptide NLVFSSLFL (SEQ ID NO: 5510) derived from the antigen P37-42.
 11. Fluorochrome and SA conjugated 270 kDa dextran coupled with HLA-A*0201 in complex with beta2microglobulin and the peptide KLAESIYKRL (SEQ ID NO: 5531) derived from the antigen P37-42.
 12. Fluorochrome and SA conjugated 270 kDa dextran coupled with HLA-A*0201 in complex with beta2microglobulin and the nonsense peptide ALIAPVHAV (SEQ ID NO: 5913).
 13. Fluorochrome and SA conjugated 270 kDa dextran coupled with HLA-A*0201 in complex with beta2microglobulin and the positive control peptide NLVPMVATV (SEQ ID NO: 5914).
 14. Fluorochrome and SA conjugated 270 kDa dextran coupled with HLA-A*0201 in complex with beta2microglobulin and the positive control peptide GLCTVAML.
 15. Fluorochrome and SA conjugated 270 kDa dextran coupled with HLA-A*0201 in complex with beta2microglobulin and the positive control peptide GILGFVFTL (SEQ ID NO: 5916).

All the above Dextramer reagents were made in 2 variants: 1 where the fluorochrome was PE and 1 where the fluorochrome was APC. The *Borrelia*-specific MHC Dextramers were used to determine the presence of OppA-, DbpA-, Flhf-, FlaB- and/or P37-42-specific T cells in blood from *Borrelia* infected individuals by flow cytometry following a standard flow cytometry protocol as described elsewhere herein. In brief, the flow cytometry analysis protocol was:
 1) Prepare lymphocytes
 2) Viability staining of cells
 3) Stain cells with Dextramer panel
 4) Stain cells with anti-CD3-PE-CY7, anti-CD14-FITC and anti-CD8-PB
 5) Wash cells and analyze by flow cytometry
 6) Exclude dead cells, monocytes and CD8− cells
 7) Identify *Borrelia*-specific CD8+ T cells Blood samples from 14 neuroborreliosis patients, 16 healthy seronegative control subjects, 18 healthy seropositive controls and 19 HLA-mismatched controls were analyzed with the Dextramer panel. The 11 *Borrelia* Dextramers (construct 1-11) described above were tested in 3 pools on each sample together with a negative pool (construct 12) and a positive control pool (construct 13-15):
 1. The first *Borrelia*-specific Dextramer pool included construct 1, 2, 3 and 4 displaying the peptides YLNTKSNG-NYEI (SEQ ID NO: 359) and FLSIFTQGYT (SEQ ID NO: 241) derived from the antigen OppA, GIYDLILNA (SEQ ID NO: 2761) derived from the antigen DbpA and YIKDINEFI (SEQ ID NO: 4479) derived from the antigen Flhf.
 2. The second pool included construct 5-7 displaying the peptides IQIEIEQLTDEI (SEQ ID NO: 5126), RMISDQRANLGA (SEQ ID NO: 5127) and SQGGVNSPV (SEQ ID NO: 5112) derived from the antigen FlaB.
 3. The third pool included construct 8-11 displaying the peptides MLDEAKDKL (SEQ ID NO: 5516), FMEQATN-SWI (SEQ ID NO: 5530), NLVFSSLFL (SEQ ID NO: 5510) and KLAESIYKRL (SEQ ID NO: 5531) derived from the antigen P37-42.

Flow cytometry results from *Borrelia* Dextramer panel analysis of a healthy control sample and sample from a neuroborreliosis patient is shown in FIG. 4 A. The results of the analysis of all samples showed that Neuroborreliosis patients had significantly elevated numbers of *Borrelia*-specific T cells compared to seronegative and seropositive healthy individuals. The healthy seropositive (SP) control group include subjects with a past cleared *Borrelia* infection as well as forest workers continuously exposed to ticks. Also, no *Borrelia*-specific T cells were detected in HLA-mismatched control samples, verifying the specificity of the *Borrelia* Dextramer panel (FIG. 4 B). In FIG. 4 C the population of forest workers (FW) that was tested seropositive for *Borrelia* but has been diagnosed as being healthy is included separately from the subjects with a past cleared *Borrelia* infection (SP). This study is a proof of concept that the assay does not give false positives in populations that are constitutively exposed to ticks.

These findings show that the *Borrelia* Dextramer panel can identify *Borrelia*-specific T cell responses in neuroborreliosis patients. The *Borrelia*-specific T cell responses are significantly elevated in neuroborreliosis patients when compared to healthy seronegative controls. Furthermore, the *Borrelia* Dextramer panel has the potential to discriminate between active and past cleared *Borrelia* infection.

Example 27

This is an example of how MHC multimers may be used for diagnosis of Lyme Disease in blood samples from humans infected with *Borrelia* bacteria.

In this example the MHC multimer used are MHC complexes coupled to the fluorophore-labelled multimerization domain Streptavidin (SA), used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from regions in OppA (Table A), DbpA (Table B), Flhf (Table C), FlaB (Table D), P37-42 (Table E) from the three species *Borrelia Burgdorferi*, *Borrelia Garinii* and *Borrelia Afzelii* or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

1. APC-SA conjugated 270 kDa dextran coupled with HLA-A*0201 in complex with beta2microglobulin and the peptide YLNTKSNGNYEI (SEQ ID NO: 359) derived from the antigen OppA.
2. APC-SA conjugated 270 kDa dextran coupled with HLA-A*0201 in complex with beta2microglobulin and the peptide FLSIFTQGYT (SEQ ID NO: 241) derived from the antigen OppA.
3. APC-SA conjugated 270 kDa dextran coupled with HLA-A*0201 in complex with beta2microglobulin and the peptide GIYDLILNA (SEQ ID NO: 2761) derived from the antigen DbpA.
4. APC-SA conjugated 270 kDa dextran coupled with HLA-A*0201 in complex with beta2microglobulin and the peptide YIKDINEFI (SEQ ID NO: 4479) derived from the antigen Flhf.
5. APC-SA conjugated 270 kDa dextran coupled with HLA-A*0201 in complex with beta2microglobulin and the peptide IQIEIEQLTDEI (SEQ ID NO: 5126) derived from the antigen FlaB.
6. APC-SA conjugated 270 kDa dextran coupled with HLA-A*0201 in complex with beta2microglobulin and the peptide RMISDQRANLGA (SEQ ID NO: 5127) derived from the antigen FlaB.
7. APC-SA conjugated 270 kDa dextran coupled with HLA-A*0201 in complex with beta2microglobulin and the peptide SQGGVNSPV (SEQ ID NO: 5112) derived from the antigen FlaB.
8. APC-SA conjugated 270 kDa dextran coupled with HLA-A*0201 in complex with beta2microglobulin and the peptide MLDEAKDKL (SEQ ID NO: 5516) derived from the antigen P37-42.
9. APC-SA conjugated 270 kDa dextran coupled with HLA-A*0201 in complex with beta2microglobulin and the peptide FMEQATNSWI (SEQ ID NO: 5530) derived from the antigen P37-42.
10. APC-SA conjugated 270 kDa dextran coupled with HLA-A*0201 in complex with beta2microglobulin and the peptide NLVFSSLFL (SEQ ID NO: 5510) derived from the antigen P37-42.
11. APC-SA conjugated 270 kDa dextran coupled with HLA-A*0201 in complex with beta2microglobulin and the peptide KLAESIYKRL (SEQ ID NO: 5531) derived from the antigen P37-42.
12. APC-SA conjugated 270 kDa dextran coupled with HLA-A*0201 in complex with beta2microglobulin and the nonsense peptide ALIAPVHAV (SEQ ID NO: 5913).

The binding of the above described MHC(peptide)/APC dextran can be used to determine the presence of DbpA, OppA, Flhf, FlaB, and P37-42 specific T cells in the blood from *Borrelia* infected individuals by flow cytometry following a standard flow cytometry protocol.

Blood from a patient with Lyme disease is isolated and 100 ul of this blood is incubated with either of the four SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analysed on flow cytometer.

The presence of cells labelled with anti-CD3/PB, anti-CD8/PE and either of the SA-MHC(peptide)/APC tetramers described above and thereby the presence of *Borrelia* specific T cells will indicate that the patient are infected with *Borrelia* bacteria. Blood analysed with SA-MHC(peptide)/APC tetramers 12 should show no staining of CD3 and CD8 positive cells with this SA-MHC(peptide)/APC tetramer.

The sensitivity of the above described diagnostic test may be enhanced by addition of labelled antibodies specific for activation markers expressed in or on the surface of the *Borrelia* specific T cells.

We conclude that the APC-SA coupled MHC(peptide) constructs may be used to detect the presence of *Borrelia* specific T cells in the blood of patients infected with *Borrelia*.

Example 28

This is an example of how MHC multimers may be used for diagnosis of Lyme Disease in blood samples from humans infected with *Borrelia* bacteria.

In this example the MHC multimer used are MHC complexes coupled to any fluorophore-labelled multimerization as described elsewhere herein. The MHC multimers are used for direct detection of TCR in flow cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0201 heavy chain, human beta2microglobulin and peptide derived from OppA (Table A), DbpA (Table B), Flhf (Table C), FlaB (Table D), and P37-42 (Table E) from the three species *Borrelia Burgdorferi*, *Borrelia Garinii* and *Borrelia Afzelii* or a negative control peptide were generated by in vitro refolding and purified or purified from antigen presenting cells. MHC-peptide complexes are then coupled to a multimerization domain together with APC.

The following MHC(peptide)/APC multimers are made:
1. APC-SA conjugated 270 kDa dextran coupled with HLA-A*0201 in complex with beta2microglobulin and the peptide YLNTKSNGNYEI (SEQ ID NO: 359) derived from the antigen OppA.
2. APC-SA conjugated 270 kDa dextran coupled with HLA-A*0201 in complex with beta2microglobulin and the peptide FLSIFTQGYT (SEQ ID NO: 241) derived from the antigen OppA.
3. APC-SA conjugated 270 kDa dextran coupled with HLA-A*0201 in complex with beta2microglobulin and the peptide GIYDLILNA (SEQ ID NO: 2761) derived from the antigen DbpA.
4. APC-SA conjugated 270 kDa dextran coupled with HLA-A*0201 in complex with beta2microglobulin and the peptide YIKDINEFI (SEQ ID NO: 4479) derived from the antigen Flhf.
5. APC-SA conjugated 270 kDa dextran coupled with HLA-A*0201 in complex with beta2microglobulin and the peptide IQIEIEQLTDEI (SEQ ID NO: 5126) derived from the antigen FlaB.
6. APC-SA conjugated 270 kDa dextran coupled with HLA-A*0201 in complex with beta2microglobulin and the peptide RMISDQRANLGA (SEQ ID NO: 5127) derived from the antigen FlaB.
7. APC-SA conjugated 270 kDa dextran coupled with HLA-A*0201 in complex with beta2microglobulin and the peptide SQGGVNSPV (SEQ ID NO: 5112) derived from the antigen FlaB.
8. APC-SA conjugated 270 kDa dextran coupled with HLA-A*0201 in complex with beta2microglobulin and the peptide MLDEAKDKL (SEQ ID NO: 5516) derived from the antigen P37-42.
9. APC-SA conjugated 270 kDa dextran coupled with HLA-A*0201 in complex with beta2microglobulin and the peptide FMEQATNSWI (SEQ ID NO: 5530) derived from the antigen P37-42.
10. APC-SA conjugated 270 kDa dextran coupled with HLA-A*0201 in complex with beta2microglobulin and the peptide NLVFSSLFL (SEQ ID NO: 5510) derived from the antigen P37-42.
11. APC-SA conjugated 270 kDa dextran coupled with HLA-A*0201 in complex with beta2microglobulin and the peptide KLAESIYKRL (SEQ ID NO: 5531) derived from the antigen P37-42.
12. APC-SA conjugated 270 kDa dextran coupled with HLA-A*0201 in complex with beta2microglobulin and the nonsense peptide ALIAPVHAV (SEQ ID NO: 5913).

The binding of the above described MHC(peptide)/APC multimers can be used to determine the presence of DbpA, OppA, Flhf, FlaB, and P37-42 specific T cells in the blood from *Borrelia* infected individuals by flow cytometry following a standard flow cytometry protocol.

Blood from a patient with Lyme disease is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analysed on flow cytometer.

The presence of cells labelled with anti-CD3/PB, anti-CD8/PE and either of the MHC(peptide)/APC multimers described above and thereby the presence of *Borrelia* specific T cells will indicate that the patient are infected with *Borrelia* bacteria. Blood analysed with MHC(peptide)/APC multimer 12 should show no staining of CD3 and CD8 positive cells with this SA-MHC(peptide)/APC multimer.

The sensitivity of the above described diagnostic test may be enhanced by addition of labelled antibodies specific for activation markers expressed in or on the surface of the *Borrelia* specific T cells.

We conclude that the APC-multimerization domain coupled MHC(peptide) constructs may be used to detect the presence of *Borrelia* specific T cells in the blood of patients infected with *Borrelia*.

Example 29

This is an example of how MHC multimers may be used for diagnosis of Lyme Disease in blood samples from humans infected with *Borrelia* bacteria.

In this example the MHC multimer used are MHC complexes coupled to fluorophore-labelled dextran (Dextramers). The dextramers are used for direct detection of TCR in flow Cytometry. The antigen origin is *Borrelia*, thus, immune monitoring of a *Borrelia* infection.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of patients infected with *Borrelia*.

Purified MHC-peptide complexes consisting of HLA-A*0301 heavy chain, human beta2microglobulin and peptide derived from OppA (Table A), DbpA (Table B), Flhf (Table C), FlaB (Table D), and P37-42 (Table E) in the three species *Borrelia Burgdorferi*, *Borrelia Garinii* and *Borrelia Afzelii* or a negative control peptide were generated by in vitro refolding, purified and biotinylated as described elsewhere herein. Biotinylated MHC-peptide complexes were then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes were added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC(peptide)/APC dextran constructs were made:

1. APC-SA conjugated 270 kDa dextran coupled with HLA-A*0301 in complex with beta2microglobulin and the peptide VTSGPFKLK (SEQ ID NO: 413) derived from OppA.
2. APC-SA conjugated 270 kDa dextran coupled with HLA-A*0301 in complex with beta2microglobulin and the peptide KLKERIPNEK (SEQ ID NO: 1412) derived from OppA.
3. APC-SA conjugated 270 kDa dextran coupled with HLA-A*0301 in complex with beta2microglobulin and the peptide NMVTSGPFK (SEQ ID NO: 683) derived from OppA.
4. APC-SA conjugated 270 kDa dextran coupled with HLA-A*0301 in complex with beta2microglobulin and the peptide IIAIVKVMK (SEQ ID NO: 3002) derived from DbpA.
5. APC-SA conjugated 270 kDa dextran coupled with HLA-A*0301 in complex with beta2microglobulin and the peptide KARLESSVK (SEQ ID NO: 3019) derived from DbpA.
6. APC-SA conjugated 270 kDa dextran coupled with HLA-A*0301 in complex with beta2microglobulin and the peptide LLAACSLTGK (SEQ ID NO: 3035) derived from DbpA.
7. APC-SA conjugated 270 kDa dextran coupled with HLA-A*0301 in complex with beta2microglobulin and the peptide KNARVMTYK (SEQ ID NO: 4515) derived from Flhf.
8. APC-SA conjugated 270 kDa dextran coupled with HLA-A*0301 in complex with beta2microglobulin and the peptide VLKEVKSLK (SEQ ID NO: 4516) derived from Flhf.
9. APC-SA conjugated 270 kDa dextran coupled with HLA-A*0301 in complex with beta2microglobulin and the peptide SLKTELAHK (SEQ ID NO: 4517) derived from Flhf.
10. APC-SA conjugated 270 kDa dextran coupled with HLA-A*0301 in complex with beta2microglobulin and the peptide NQMHMLSNK (SEQ ID NO: 5132) derived from FlaB.
11. APC-SA conjugated 270 kDa dextran coupled with HLA-A*0301 in complex with beta2microglobulin and the peptide SINAANLSK (SEQ ID NO: 5133) derived from FlaB.
12. APC-SA conjugated 270 kDa dextran coupled with HLA-A*0301 in complex with beta2microglobulin and the peptide SQASRNTSK (SEQ ID NO: 5162) derived from FlaB.
13. APC-SA conjugated 270 kDa dextran coupled with HLA-A*0301 in complex with beta2microglobulin and the peptide RLYNGNSYR (SEQ ID NO: 5552) derived from P37-42.
14. APC-SA conjugated 270 kDa dextran coupled with HLA-A*0301 in complex with beta2microglobulin and the peptide ATNSWISAK (SEQ ID NO: 5550) derived from P37-42.
15. APC-SA conjugated 270 kDa dextran coupled with HLA-A*0301 in complex with beta2microglobulin and the peptide KLAESIYKR (SEQ ID NO: 5551) derived from P37-42.
16. APC-SA conjugated 270 kDa dextran coupled with HLA-A*0301 in complex with beta2microglobulin and the HIV peptide QVPLRPMTYK (SEQ ID NO: 5920).

The binding of the above described MHC(peptide)/APC dextran can be used to determine the presence of DbpA, OppA, Flhf, FlaB, and P37-42 specific T cells in the blood from Borrelia infected individuals by flow cytometry following a standard flow cytometry protocol.

Blood from a patient with Lyme disease is isolated and 100 ul of this blood is incubated with 10 µl of one of the MHC(peptide)/APC dextran constructs described above for 10 minutes in the dark at room temperature. 5 µl of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analysed on flow cytometer.

The presence of cells labelled with anti-CD3/PB, anti-CD8/PE and either of the MHC(peptide)/APC dextran constructs described above and thereby the presence of Borrelia specific T cells will indicate that the patient are infected with Borrelia bacteria. Blood analysed with the HIVMHC(peptide)/APC dextran construct should show no staining of CD3 and CD8 positive cells with this MHC(peptide)/APC dextran construct.

The sensitivity of the above described diagnostic test may be enhanced by addition of labelled antibodies specific for activation markers expressed in or on the surface of the Borrelia specific T cells.

We conclude that the APC-SA conjugated 270 kDa dextran coupled MHC(peptide) constructs may be used to detect the presence of Borrelia specific T cells in the blood of patients infected with Borrelia.

Example 30

This is an example of how MHC multimers may be used for diagnosis of Lyme Disease in blood samples from humans infected with Borrelia bacteria.

In this example the MHC multimer used are MHC complexes coupled to the fluorophore-labelled multimerization domain Streptavidin (SA), used for direct detection of TCR in flow Cytometry. The antigen origin is Borrelia, thus, immune monitoring of a Borrelia infection.

Lyme disease is caused by infection by Borrelia bacteria. During acute infection Borrelia specific activated T cells will be present in increased amounts in an activated state compared to healthy individuals. The presences of an increased amount of activated Borrelia specific T cells may thereby act as a surrogate marker for infection with Borrelia bacterium. MHC multimers carrying Borrelia specific antigenic peptides is in this example used to detect the presence of Borrelia specific T cells in the blood of patients infected with Borrelia.

Purified MHC-peptide complexes consisting of HLA-A*0301 heavy chain, human beta2microglobulin and peptide derived from OppA (Table A), DbpA (Table B), Flhf (Table C), FlaB (Table D), and P37-42 (Table E) in the three species Borrelia Burgdorferi, Borrelia Garinii and Borrelia

*Afzelii* or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

1. APC-SA coupled with HLA-A*0301 in complex with beta2microglobulin and the peptide VTSGPFKLK (SEQ ID NO: 413) derived from OppA.
2. APC-SA coupled with HLA-A*0301 in complex with beta2microglobulin and the peptide KLKERIPNEK (SEQ ID NO: 1412) derived from OppA.
3. APC-SA coupled with HLA-A*0301 in complex with beta2microglobulin and the peptide NMVTSGPFK (SEQ ID NO: 683) derived from OppA
4. APC-SA coupled with HLA-A*0301 in complex with beta2microglobulin and the peptide IIAIVKVMK (SEQ ID NO: 3002) derived from DbpA.
5. APC-SA coupled with HLA-A*0301 in complex with beta2microglobulin and the peptide KARLESSVK (SEQ ID NO: 3019) derived from DbpA.
6. APC-SA coupled with HLA-A*0301 in complex with beta2microglobulin and the peptide LLAACSLTGK (SEQ ID NO: 3035) derived from DbpA
7. APC-SA coupled with HLA-A*0301 in complex with beta2microglobulin and the peptide KNARVMTYK (SEQ ID NO: 4515) derived from Flhf.
8. APC-SA coupled with HLA-A*0301 in complex with beta2microglobulin and the peptide VLKEVKSLK (SEQ ID NO: 4516) derived from Flhf.
9. APC-SA coupled with HLA-A*0301 in complex with beta2microglobulin and the peptide SLKTELAHK (SEQ ID NO: 4517) derived from Flhf
10. APC-SA coupled with HLA-A*0301 in complex with beta2microglobulin and the peptide NQMHMLSNK (SEQ ID NO: 5132) derived from FlaB.
11. APC-SA coupled with HLA-A*0301 in complex with beta2microglobulin and the peptide SINAANLSK (SEQ ID NO: 5133) derived from FlaB.
12. APC-SA coupled with HLA-A*0301 in complex with beta2microglobulin and the peptide SQASRNTSK (SEQ ID NO: 5162) derived from FlaB
13. APC-SA coupled with HLA-A*0301 in complex with beta2microglobulin and the peptide RLYNGNSYR (SEQ ID NO: 5552) derived from P37-42.
14. APC-SA coupled with HLA-A*0301 in complex with beta2microglobulin and the peptide ATNSWISAK (SEQ ID NO: 5550) derived from P37-42.
15. APC-SA coupled with HLA-A*0301 in complex with beta2microglobulin and the peptide KLAESIYKR (SEQ ID NO: 5551) derived from P37-42
16. APC-SA coupled with HLA-A*0201 in complex with beta2microglobulin and the HIV peptide QVPLRPMTYK (SEQ ID NO: 5920).

The binding of the above described MHC(peptide)/APC dextran can be used to determine the presence of DbpA, OppA, Flhf, FlaB, and P37-42 specific T cells in the blood from *Borrelia* infected individuals by flow cytometry following a standard flow cytometry protocol.

Blood from a patient with Lyme disease is isolated and 100 ul of this blood is incubated with either of the four SA-MHC(peptide)/APC tetramers described above for 10 minutes in the dark at room temperature. 5 μl of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analysed on flow cytometer.

The presence of cells labelled with anti-CD3/PB, anti-CD8/PE and either of the SA-MHC(peptide)/APC tetramers described above and thereby the presence of *Borrelia* specific T cells will indicate that the patient are infected with *Borrelia* bacteria. Blood analysed with the HIV SA-MHC (peptide)/APC tetramer should show no staining of CD3 and CD8 positive cells with this SA-MHC(peptide)/APC tetramer.

The sensitivity of the above described diagnostic test may be enhanced by addition of labelled antibodies specific for activation markers expressed in or on the surface of the *Borrelia* specific T cells.

We conclude that the APC-SA coupled MHC(peptide) constructs may be used to detect the presence of *Borrelia* specific T cells in the blood of patients infected with *Borrelia*.

Example 31

This is an example of measurement of antigen reactive T-Cells by IFN-γ capture in blood samples by ELISPOT.

This is an example of indirect detection of TCR, where individual cells are immobilized and measured by a chromogen assay.

The example provides a sensitive assay for the detection of T-cells reactive to an antigen by detecting a soluble factor whose secretion is induced by stimulation of the T-cell by the antigen.

A summary flow chart of the method is shown in FIG. 6. In brief, peripheral blood is diluted threefold in Dulbecco's phosphate buffered saline (DPBS), underlain with 15 ml of Ficoll (Pharmacia Ficoll-Paque #17-0840-02, Piscataway, N.J.) per 40 ml diluted blood in a 50 ml polypropylene centrifuge tube, and spun at 2000 RPM for 20 minutes in a Beckman CS-6R centrifuge (Beckman Inc., Palo Alto, Calif.). The buffy layer at the DPBS/Ficoll interface is removed, washed twice with DPBS and once with human tissue culture medium (hTCM: αMEM+5% heat inactivated human AB serum (Ultraserum, BioWhittaker, Walkersville, Md.), penicillin/streptomycin, 1-glutamine) at low RCF to remove platelets. Sixty percent of the PBMCs are resuspended in freezing medium (10% dimethyl sulfoxide(Sigma Chenical Co., St. Louis, Mo.), 90% fetal bovine serum to a concentration of $5 \times 10^6$ cells/ml, frozen in a programmable Cryo-Med (New Baltimore, Mich.) cell freezer, and stored under liquid nitrogen until needed.

The purified PBMCs are plated at $2 \times 10^5$ cells/well at a volume of 0.1 ml in 96 well Costar cell culture plates. An equal volume of antigen at 10 μg/ml is added to triplicate or sextuplet sets of wells and the plate is incubated in a 37° C., 5% $CO_2$ incubator. On day five, 10 μl/well of 100 U/ml stock recombinant IL-2 (Advanced Biotechnologies Inc., Columbia, Md.) is added to each well. On day 8, frozen PBMCs are thawed, washed in DPBS+0.5% bovine serum albumin (BSA) to remove DMSO, resuspended to a concentration of $4 \times 10^6$ cells/ml in hTCM, and γ-irradiated (3,000 RADS). Fifty microliters/well are dispensed along with 50 μl of the appropriate antigen at a stock concentration of 40 µl/ml to give a final antigen concentration of 10 µg/ml.

To prepare a capture plate, IFN-γ capture antibody (monoclonal mouse anti-human IFN-g, Endogen #M700A, Cambridge, Mass.) is diluted to 10 µg/ml in sterile 0.1 M $Na(CO_3)_2$ pH 8.2 buffer, aliquoted at 50 µl/well in flat bottomed 96 well sterile microtiter plates (Corning Costar Corp.), and incubated at 4° C. for a minimum of 24 hours. Prior to use, excess antibody is removed and wells are washed twice with dPBS+1% Tween 20 (PBST). To block further nonspecific protein binding, plates are incubated with 250 µl/well of PBS+5% BSA at room temperature for 1 hour. After discarding the blocking solution, wells are washed once with PBST (0.1% Tween), followed by hTCM in preparation for the antigen stimulated cells.

On day 9 of the assay, twenty four hours after the second antigen stimulation, the stimulation plate is spun for 5 minutes at 1500 RPM in a Beckman CS-6R centrifuge and 90 µl of supernatant is carefully removed from each well with a micropipette. The pelleted cells are resuspended in 100 µl of hTCM, pooled in sterile tubes (Corning Costar corp sterile ClusterTAb #4411, Cambridge, Mass.), mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 µl of a 1:500 dilution of rabbit anti-human IFN-γ polyclonal antibody (Endogen #P700, Cambridge, Mass.) in PBST+1% BSA is added to each well for 3.5 hours at room temperature with gentle rocking. Unbound anti-IFN-γ polyclonal antibody is removed by three washes with PBST, followed by a wash with 250 µl of 1× Tris-buffered saline+0.05% Tween 20 (TBST). Next, a 100 µl aliquot of 1:5000 alkaline phosphatase-conjugated mouse anti-rabbit polyclonal antibody (Jackson Immunological #211-055-109, West Grove, Pa.) diluted in TBST is added to each well and incubated at room temperature for 1.5-2 hours with gentle rocking. Excess enzyme-conjugated antibody is removed by three washes with PBST and two washes with alkaline phosphatase buffer (APB=0.1 M NaCl, 0.05 M $MgCl_2$, 0.1 M Tris HCl, pH 9.5) followed by addition of the substrate mix of p-Toluidine salt and nitroblue tetrazolium chloride (BCIP/NBT, GIBCO BRL #18280-016, Gaithersburg, Md.). To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analysed by NIH image software. Captured images are enhanced using the Look Up Table which contrasts the images. Thresholding is then applied to every image and a wand tool is used to highlight the border to effectively subtract the edge of the well so that background counts won't be high and artificial. Density slicing over a narrow range is then used to highlight the spots produced from secreting cells. Pixel limits are set to subtract out small debris and large particles, and the number of spots falling within the prescribed pixel range are counted by the software program. Totals from each well are then manually recorded for future analysis. Alternatively, spots can be counted by other commercially available or customized software applications, or may be quantitated manually by a technician using standard light microscopy. Spots can also be counted manually under a light microscope.

We conclude that the protocol detailed above can be used for the enumeration of single IFN-γ secreting T cells.

Example 32

This is an example of measurement of antigen reactive T-Cells by IFN-γ capture in blood samples by ELISPOT.

This is an example of indirect detection of TCR, where individual cells are immobilized and measured by a chromogen assay. The antigenic peptide origin is a library of antigens.

The example provides a sensitive assay for the detection of T-cells reactive to the antigen of a library generated as described in Example 24, by detecting a soluble factor whose secretion is induced by stimulation of the T-cell by the antigen.

This example is similar to the experiment above. PMBC are isolated, prepared and stored as described in the example above. The purified PBMCs are plated at $2\times10^5$ cells/well at a volume of 0.1 ml in 96 well Costar cell culture plates. An equal volume of antigens from the library, at 10 µg/ml is added to triplicate or sextuplet sets of wells and the plate is incubated in a 37° C., 5% $CO_2$ incubator. On day five, 10 µl/well of 100 U/ml stock recombinant IL-2 is added to each well. On day 8, frozen PBMCs are thawed, washed in DPBS+0.5% BSA to remove DMSO, resuspended to a concentration of $4\times10^6$ cells/ml in hTCM, and γ-irradiated (3,000 RADS). 50 µl/well are dispensed along with 50 µl of the appropriate antigen at a stock concentration of 40 µl/ml to give a final antigen concentration of 10 µg/ml. A capture plate with IFN-γ antibody is prepared, washed and blocked as described in the example above.

On day 9 of the assay, twenty-four hours after the second antigen stimulation, the stimulation plate is spun for 5 minutes at 1500 RPM and 90 µl of supernatant is carefully removed from each well with a micropipette. The pelleted cells are resuspended in 100 µl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 µl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 µl of 1× Tris-buffered saline+0.05% Tween 20 (TBST). Next, a 100 µl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analysed as described in the example above We conclude that the experiment detailed above can be used for the enumeration of single IFN-γ secreting T cells in blood.

Example 33

This is an example of measurement of antigen reactive T-Cells by IFN-γ capture in blood samples from *Borrelia* patients by ELISPOT.

This is an example of indirect detection of TCR, where individual cells are immobilized and measured by a chromogen assay. The antigenic peptide origin is *Borrelia*, thus, immune monitoring of *Borrelia*.

The example provides a sensitive assay for the detection of T-cells reactive to one or more of the *Borrelia* antigens DbpA, OppA, Flhf, FlaB and/or P37-42 by detecting a soluble factor whose secretion is induced by stimulation of the T-cell by the antigen.

This example is similar to the experiment above. PBMCs from *Borrelia* patients are isolated, prepared and stored as described in the example above. The purified PBMCs are plated at $2 \times 10^5$ cells/well at a volume of 0.1 ml in 96 well Costar cell culture plates. An equal volume of a mix of antigenic peptides from DbpA, OppA, Flhf, FlaB, P37-42 protein, at 10 µg/ml is added to triplicate or sextuplet sets of wells and the plate is incubated in a 37° C., 5% $CO_2$ incubator. On day five, 10 µl/well of 100 U/ml stock recombinant IL-2 is added to each well. On day 8, frozen PBMCs are thawed, washed in DPBS+0.5% BSA to remove DMSO, resuspended to a concentration of $4 \times 10^6$ cells/ml in hTCM, and γ-irradiated (3,000 RADS). 50 µl/well are dispensed along with 50 µl of the appropriate antigen at a stock concentration of 40 µl/ml to give a final antigen concentration of 10 µg/ml. A capture plate with IFN-γ antibody is prepared, washed and blocked as described in the example above.

On day 9 of the assay, twenty-four hours after the second antigen stimulation, the stimulation plate is spun for 5 minutes at 1500 RPM and 90 µl of supernatant is carefully removed from each well with a micropipette. The pelleted cells are resuspended in 100 µl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 µl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 µl of 1× Tris-buffered saline+0.05% Tween 20 (TBST). Next, a 100 µl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven. Images of the spots corresponding to the lymphokine secreted by individual antigen-stimulated T cells are captured with a CCD video camera and the image is analysed as described in the example above We conclude that the experiment detailed above can be used for the enumeration of single IFN-γ secreting T cells in blood from *Borrelia* patients.

Example 34

This is an example of how antigen-specific T-cells can be detected using a direct detection method detecting T cell immobilized in solid tissue. In this example MHC dextramers are used to detect antigen-specific T cells on frozen tissue sections using enzymatic chromogenic precipitation detection.

Equilibrate the cryosection tissue (e.g. section of spleen from transgenic mice) to −20° C. in the cryostate. Cut 5 µm sections and then dry sections on slides at room temperature. Store slides frozen until use at −20° C.

Equilibrate frozen sections to room temperature. Fix with acetone for 5 min. Immediately after fixation transfer slides to TBS buffer (50 mM Tris-HCL pH 7,6, 150 mM NaCl) for 10 min.

Incubate slides with FITC-conjugated MHC-dextramers at appropriate dilution (1:40-1:80) and incubate for 30 min at room temperature. Other dilution ranges, as well as incubation time and temperature, may be desirable.

Decant solution and gently tap slides against filter paper, submerge in TBS buffer.

Decant and wash for 10 min in TBS buffer.

Incubate with rabbit polyclonal anti-FITC antibody (Dako P5100) at 1:100 dilution in TBS at room temperature for 30 min.

Repeat step 5 and 6.

Incubate with Envision anti-Rabbit HRP (Dako K4003) at room temperature for 30 min.

Other visualization systems may be used.

Repeat step 5 and 6.

Develop with DAB+(Dako K3468) in fume hood for 10 min. Other substrates may be used Rinse slides in tap-water for 5 min.

Counterstain with hematoxylin (Dako S3309) for 2 min.

Repeat step 12, mount slides.

The slides stained with MHC-Dextramers can now be evaluated by microscopy.

Example 35

This is an example of how antigen-specific T-cells can be detected using a direct detection method detecting T cell immobilized in solid tissue. In this example MHC dextramers are used to detect antigen-specific T cells on paraffin embedded tissue sections using enzymatic chromogenic precipitation detection.

Formaldehyde fixed paraffin-embedded tissue are cut in section and mounted on the glass slice, for subsequent IHC staining with MHC-dextramers. Tissue fixed and prepared according to other protocols may be used as well. E.g. fresh tissue, lightly fixed tissue section (e.g. tissue fixed in 2% formaldehyde) or formalin-fixed, paraffin-embedded tissue section.

Optimal staining may require target retrieval treatment with enzymes as well as heating in a suitable buffer before incubation with antibodies and MHC-dextramer.

The sample is stained for DNA using DAPI stain, followed by incubated with an antigen-specific MHCdex/FITC reagent, followed by addition of anti-FITC antibody labelled with HRP.

Then the substrate for HRP, "DAP" is added and the reaction allows to progress.

The sample is analysed by light microscopy for the present of a coloured precipitate on the cells (DAPI stained nucleus) positive for the specific MHC/dex reagent.

A digital image of the stained sample is obtained, and this can be analysed manually in the same way as by microscopy. However, a digital image may be used for automatic determination of where and how many cells that are positive, related to the total amount of cells, determined by the DAPI staining, or other criteria or stainings.

Example 36

This example describes the generation and application of negative controls, where the MHC complex is HLA-A*0201 loaded with the nonsense peptide ALIAPVHAV (SEQ ID NO: 5913) and these MHC complexes are coupled to a 270 kDa dextran multimerization domain. The nonsense peptide have an amino acid sequence different from the linear sequence of any peptide derived from any known naturally occurring protein. This was analysed by a blast search. The amino acids at position 2 and 9 can serve as anchor residues when binding to HLA-A*0201 molecules.

Purified MHC(peptide) molecules consisting of the allele HLA-A*0201, human beta2microglobulin and peptide was generated by in vitro refolding, purified and biotinylated as described elsewhere herein. Biotinylated HLA-A*0201 (peptide) was mixed with APC-SA-conjugated 270 kDa dextran in an amount corresponding to a ratio of three biotinylated HLA-A*0201(peptide) molecules per SA molecule and incubated for 30 minutes in the dark at room temperature. The APC-SA-conjugated 270 kDa dextran contained 9 molecules APC and 3,7 molecules SA per dextran molecule. Following incubation the mixture was diluted into a buffer containing 0,05M Tris/HCl, 15 nM $NaN_3$ and 1% BSA to a final concentration of $3,8 \times 10^8$ M dextran.

By this procedure the following MHC multimer constructs were made:

A negative control construct comprising APC-SA-conjugated 270 kDa dextran and biotinylated HLA-A*0201 in complex with beta2microglobulin and the nonsense peptide ALIAPVHAV (SEQ ID NO: 5913).

A construct comprising APC-SA-conjugated 270 kDa dextran and biotinylated HLA-A*0201 in complex with beta2microglobulin and the peptide YLNTKSNGNYEI (SEQ ID NO: 359) derived from the antigen OppA.

A construct comprising APC-SA-conjugated 270 kDa dextran and biotinylated HLA-A*0201 in complex with beta2microglobulin and the peptide FLSIFTQGYT (SEQ ID NO: 241) derived from the antigen OppA.

A construct comprising APC-SA-conjugated 270 kDa dextran and biotinylated HLA-A*0201 in complex with beta2microglobulin and the peptide GIYDLILNA (SEQ ID NO: 2761) derived from the antigen DbpA.

A construct comprising APC-SA-conjugated 270 kDa dextran and biotinylated HLA-A*0201 in complex with beta2microglobulin and the peptide YIKDINEFI (SEQ ID NO: 4479) derived from the antigen Flhf.

A construct comprising APC-SA-conjugated 270 kDa dextran and biotinylated HLA-A*0201 in complex with beta2microglobulin and the peptide IQIEIEQLTDEI (SEQ ID NO: 5126) derived from the antigen FlaB.

A construct comprising APC-SA-conjugated 270 kDa dextran and biotinylated HLA-A*0201 in complex with beta2microglobulin and the peptide RMISDQRANLGA (SEQ ID NO: 5127) derived from the antigen FlaB.

A construct comprising APC-SA-conjugated 270 kDa dextran and biotinylated HLA-A*0201 in complex with beta2microglobulin and the peptide SQGGVNSPV (SEQ ID NO: 5112) derived from the antigen FlaB.

A construct comprising APC-SA-conjugated 270 kDa dextran and biotinylated HLA-A*0201 in complex with beta2microglobulin and the peptide MLDEAKDKL (SEQ ID NO: 5516) derived from the antigen P37-42.

A construct comprising APC-SA-conjugated 270 kDa dextran and biotinylated HLA-A*0201 in complex with beta2microglobulin and the peptide FMEQATNSWI (SEQ ID NO: 5530) derived from the antigen P37-42.

A construct comprising APC-SA-conjugated 270 kDa dextran and biotinylated HLA-A*0201 in complex with beta2microglobulin and the peptide NLVFSSLFL (SEQ ID NO: 5510) derived from the antigen P37-42.

A construct comprising APC-SA-conjugated 270 kDa dextran and biotinylated HLA-A*0201 in complex with beta2microglobulin and the peptide KLAESIYKRL (SEQ ID NO: 5531) derived from the antigen P37-42.

The binding of the HLA-A*0201(peptide)/APC dextran constructs to Human Peripheral Blood Mononuclear Cells (HPBMC) from various donors is analysed by flow cytometry following a standard flow cytometry protocol. HPBMC from the blood of 9 individual donors is isolated by a standard protocol using Ficoll-Hypaque. $1 \times 10^6$ purified HPBMC at a concentration of $2 \times 10^7$ cells/ml are incubated with 10 μl of one of the HLA-A*0201(peptide)/APC dextran constructs described above for 10 minutes in the dark at room temperature. 10 μl of each of the antibodies mouse-anti-human CD3/PE (clone UCHT1 from Dako) and mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 μl PBS; pH=7.2 and analysed on a CYAN ADP flow cytometer.

This experiment will demonstrate that the negative MHC multimer construct did not stain any specific T cells in lymphocyte preparations from different donors. Donors known to have specific T cells for either of the abovementioned peptides will demonstrate positive staining with the corresponding MHC multimer construct. The nonsense peptide multimer construct is therefore a suitable negative controls when using HLA-A*0201(peptide) multimers for detection of specific T cells in Flow Cytometry.

Example 37

This is an example of how to generate and use negative controls, where the MHC complex is any MHC I complex of human, mouse, rabbit, rat, swine or monkey origin loaded with a nonsense peptide. A nonsense peptide is here to be understood as a peptide having an amino acid sequence different from any peptide derived from any known naturally occurring protein, and preferably is not recognized by any T cell when presented by a MHC complex. The nonsense peptide has amino acid residues at relevant positions that anchor the peptide to the peptide-binding groove of the MHC complex. The MHC(nonsense peptide) complex is coupled to a 270 kDa dextran multimerization domain.

Purified MHC(peptide) molecules consisting of the alpha chain, human beta2microglobulin and peptide is generated by in vitro refolding, purified and biotinylated as described elsewhere. Biotinylated MHC(peptide) is mixed with APC-SA-conjugated 270 kDa dextran in amounts corresponding to a ratio of three biotinylated MHC(peptide) molecules per SA molecule and incubated for 30 minutes in the dark at room temperature. The APC-SA-conjugated 270 kDa dextran contains 9 molecules APC and 3,7 molecules SA per dextran molecule. Following incubation the mixture is diluted into a buffer containing 0,05M Tris/HCl, 15 nM NaN$_3$ and 1% BSA to a final concentration of 3,8×10$^{-8}$ M dextran.

By this procedure the following MHC complex constructs are made:
1. A negative control construct comprising APC-SA-conjugated 270 kDa dextran and biotinylated alpha chain in complex with beta2microglobulin and a corresponding nonsense peptide. A nonsense peptide is here to be understood as a peptide with an amino acid sequence different from any peptide derived from any known naturally occurring protein and the nonsense peptide is not recognized by any T cell when presented by an MHC complex.
2. A construct comprising APC-SA-conjugated 270 kDa dextran and biotinylated alpha chain in complex with beta2microglobulin and a peptide derived from a known protein.

The binding of the MHC(peptide)/APC dextran constructs to Human Peripheral Blood Mononuclear Cells (HPBMC) from various donors is analysed by flow cytometry following a standard flow cytometry protocol. Briefly, HPBMC from the blood of 9 individual donors are isolated by a standard protocol using Ficoll-Hypaque. 1×10$^6$ purified HPBMC at a concentration of 2×10$^7$ cells/ml is incubated with 10 µl of one of the MHC(peptide)/APC dextran constructs described above for 10 minutes in the dark at room temperature. 10 µl of each of the antibodies mouse-anti-human CD3/PE (clone UCHT1 from Dako) and mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washed cells are resuspended in 400-500 µl PBS; pH=7.2 and analysed on a CYAN ADP flow cytometer. The staining patterns of flow cytometry analysis with the two MHC(peptide)/APC constructs 1 and 2 are compared. There will be no staining observed with construct 1.

Example 38

This is an example of how to generate negative controls, where the MHC complexes is any MHC I molecule of human, mouse, rabbit, rat, swine, monkey or any other origin loaded with a nonsense peptide and where the MHC (nonsense peptide) complexes are coupled to any multimerization domain. A nonsense peptide is here to be understood as a peptide that have an amino acid sequence different from any peptide derived from any known naturally occurring protein and cannot be recognized by any T cell when presented by a MHC complex. The nonsense peptide carries amino acid residues at relevant positions that anchor the peptide to the peptide-binding groove of the MHC complex.

The MHC(nonsense peptide) complex can be made as described elsewhere herein, and can then be coupled to a relevant multimerization domain. The labelling of the multimerization domain can be optimized depending on later use of the negative control e.g. in flow cytometry analysis, IHC, ELISA or similar.

Example 39

This example describes how to identify specific T cells in a blood sample with MHC multimers using flow cytometry analysis without lysis of red blood cells and without washing the cells after staining. MHC complexes in this example consisted of HLA-A*0201 heavy chain, human beta2microglobulin and different peptides, and the MHC complexes were coupled to a 270 kDa dextran multimerization domain.

Purified MHC-peptide complexes consisting of human heavy chain, human beta2microglobulin and peptide are generated by in vitro refolding, purified and biotinylated as described elsewhere herein. Biotinylated MHC-peptide complexes are then coupled to a 270 kDa dextran multimerization domain labelled with PE by interaction with streptavidin (SA) on the dextran multimerization domain. The SA-PE-dextran is made as described elsewhere herein. MHC-peptide complexes are added in an amount corresponding to a ratio of three MHC-peptide molecules per SA molecule and each molecule dextran contained 6.1 SA molecule and 3.9 molecules PE. The final concentration of dextran is 3.8×10e-8 M. The following constructs are made:
1. PE conjugated 270 kDa dextran coupled with HLA-A*0201 in complex with beta2microglobulin and the peptide YLNTKSNGNYEI (SEQ ID NO: 359) derived from the antigen OppA.
2. PE conjugated 270 kDa dextran coupled with HLA-A*0201 in complex with beta2microglobulin and the peptide FLSIFTQGYT (SEQ ID NO: 241) derived from the antigen OppA.
3. PE conjugated 270 kDa dextran coupled with HLA-A*0201 in complex with beta2microglobulin and the peptide GIYDLILNA (SEQ ID NO: 2761) derived from the antigen DbpA.
4. PE conjugated 270 kDa dextran coupled with HLA-A*0201 in complex with beta2microglobulin and the peptide YIKDINEFI (SEQ ID NO: 4479) derived from the antigen Flhf.
5. PE conjugated 270 kDa dextran coupled with HLA-A*0201 in complex with beta2microglobulin and the peptide IQIEIEQLTDEI (SEQ ID NO: 5126) derived from the antigen FlaB.
6. PE conjugated 270 kDa dextran coupled with HLA-A*0201 in complex with beta2microglobulin and the peptide RMISDQRANLGA (SEQ ID NO: 5127) derived from the antigen FlaB.
7. PE conjugated 270 kDa dextran coupled with HLA-A*0201 in complex with beta2microglobulin and the peptide SQGGVNSPV (SEQ ID NO: 5112) derived from the antigen FlaB.
8. PE conjugated 270 kDa dextran coupled with HLA-A*0201 in complex with beta2microglobulin and the peptide MLDEAKDKL (SEQ ID NO: 5516) derived from the antigen P37-42.
9. PE conjugated 270 kDa dextran coupled with HLA-A*0201 in complex with beta2microglobulin and the peptide FMEQATNSWI (SEQ ID NO: 5530) derived from the antigen P37-42.
10. PE conjugated 270 kDa dextran coupled with HLA-A*0201 in complex with beta2microglobulin and the peptide NLVFSSLFL (SEQ ID NO: 5510) derived from the antigen P37-42.
11. PE conjugated 270 kDa dextran coupled with HLA-A*0201 in complex with beta2microglobulin and the peptide KLAESIYKRL (SEQ ID NO: 5531) derived from the antigen P37-42.
12. PE conjugated 270 kDa dextran coupled with HLA-A*0201 in complex with beta2microglobulin and the nonsense peptide ALIAPVHAV (SEQ ID NO: 5913).

These twelve MHC multimer constructs are used for detection of specific T cells in flow cytometry analysis using a no-lyse no-wash procedure. Blood samples from three individual donors are analysed. The donors had previously been screened for the presence of specific T cells using a general staining procedure including lysis and wash of the cell sample. In this experiment blood from each donor are analysed with a MHC multimer. The negative control is a nonsense peptide is here to be understood as a peptide with an amino acid sequence different from any peptide derived from any known naturally occurring protein.

The blood is stained as follows:

100 µl EDTA stabilized blood are incubated with 5 µl MHC(peptide)/PE dextran for 5 minutes at room temperature. Anti-CD45/PB, anti-CD3/FITC and anti-CD8/APC antibody in an amount of 0.4-1.2 µg/sample is added to each tube and the incubation continues for another 15 minutes. 850 µl PBS; pH=7.2 is added and the sample analysed on a CyAn ADP flowcytometry instrument with a speed of 150 µl/minute. A total of 20.000 CD8 positive cells are acquired. During analysis CD45/PB antibody is used to set a trigger discriminator to allow the flow cytometer to distinguish between red blood cells and stained white blood cells (see FIG. 5A). Furthermore CD3/FITC antibody is used to select CD3 positive cells in a second gating strategy.

We have here exemplified how MHC multimers can be used to identify specific T cells in blood samples from three different donors using an approach without lysing red blood cells and without wash following staining with MHC multimer. This method is simple, fast and interfere as little as possible with cells in the blood sample.

Example 40

This example describes how to identify specific T cells in a blood sample with MHC multimers using flow cytometry analysis without lysis of red blood cells and without washing cells upon staining. The MHC complex is here any MHC I molecule of human, rodent, bovine, monkey or any other origin loaded with any peptide able to bind the peptide-binding cleft of the MHC complex and where the MHC-peptide complexes are coupled to any multimerization domain.

Purified MHC-peptide complexes are generated as described elsewhere herein and coupled to any multimerization domain labelled with a fluorescent dye, preferable FITC, PE, APC, pacific blue, cascade yellow or any other fluorochrome. These MHC multimers are used for detection of specific T cells by flow cytometry using the following procedure:

EDTA stabilized blood are incubated with MHC multimer at room temperature. The amount of blood analysed is preferable 50-150 µl but could be any volume ranging from 1-1000 µl. The amount of MHC multimer depends on the multimer construct and the volume of blood and should be determined by titration prior to this type of experiment. The incubation time with MHC multimer is preferably 5-20 minutes but could be anything between 0 minutes and 1 hour. Then anti-CD45/CY, anti-CD3/APC and anti-CD8/PB antibody is added and the incubation continued. The incubation time is preferably 5-20 minutes but can be anything between 1 minute and 1 hour. The amount of antibody is preferable 0.4-1.2 µg/100 µl blood but these limits can be extended and should be determined by titration prior to this kind of experiments. The antibodies can be labelled with any fluorochrome as long as the fluorochrome is different from the fluorochrome on the MHC multimer. Next PBS; pH=7.0-8.0 is added and the sample analysed by a flow cytometer. The amount of PBS added is preferable 500-1000 µl but can also be more than 1000 µl and less than 500 µl. During analysis anti-CD45 antibody is used to set a trigger discriminator to allow the flow cytometer to distinguish between red blood cells and stained white blood cells. Different gating strategies can then be applied to analyse data. Preferably cells are first gated on CD3 positive cells and then for CD8 positive cells, but can also be gated only for CD8 positive cells of only for CD3 positive cells. Alternatively "dump" gates can be applied excluding unwanted cells, e.g. B-cells, CD4-positive cells, NK-cells.

In the above example MHC multimers are added prior to antibodies but MHC multimers and antibodies can also be added simultaneously to the blood sample and incubated for preferably 5-30 minutes but the incubation time can be anything between 1 minute and 2 hours.

This method can be used to identify specific T cells in blood samples from different donors using an approach without lysing red blood cells and without wash following staining with MHC multimer. This method is simple, fast and interfere as little as possible with cells in the blood sample Example 41

This is an example of how MHC multimers may be used for diagnosis of Lyme Disease in blood samples from humans infected with *Borrelia* bacteria. The MHC multimer used are MHC complexes coupled to labelled dextran.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Purified MHC-peptide complexes consisting of HLA-A*0201 heavy chain, human beta2microglobulin and peptide derived from OppA (Table A), DbpA (Table B), Flhf (Table C), FlaB (Table D), and P37-42 (Table E) conserved among the three species *Borrelia Burgdorferi, Borrelia Garinii* and *Borrelia Afzelii* or a negative control peptide were generated by in vitro refolding, purified and biotinylated as described elsewhere herein. Biotinylated MHC-peptide complexes were then coupled to a 270 kDa dextran multimerization domain labelled with APC by interaction with streptavidin (SA) on the dextran multimerization domain. The dextran-APC-SA multimerization domain was generated as described elsewhere herein. MHC-peptide complexes were added in an amount corresponding to a ratio of three MHC-peptide molecules per SA molecule and each molecule dextran contained 3.7 SA molecule and 8.95 molecules APC. The final concentration of dextran was 3.8×10e-8 M.

The following MHC(peptide)/APC dextran constructs were made:
1. APC-SA conjugated 270 kDa dextran coupled with HLA-A*0201 in complex with beta2microglobulin and the peptide YLNTKSNGNYEI (SEQ ID NO: 359) derived from the antigen OppA.

2. APC-SA conjugated 270 kDa dextran coupled with HLA-A*0201 in complex with beta2microglobulin and the peptide FLSIFTQGYT (SEQ ID NO: 241) derived from the antigen OppA.
3. APC-SA conjugated 270 kDa dextran coupled with HLA-A*0201 in complex with beta2microglobulin and the peptide GIYDLILNA (SEQ ID NO: 2761) derived from the antigen DbpA.
4. APC-SA conjugated 270 kDa dextran coupled with HLA-A*0201 in complex with beta2microglobulin and the peptide YIKDINEFI (SEQ ID NO: 4479) derived from the antigen Flhf.
5. APC-SA conjugated 270 kDa dextran coupled with HLA-A*0201 in complex with beta2microglobulin and the peptide IQIEIEQLTDEI (SEQ ID NO: 5126) derived from the antigen FlaB.
6. APC-SA conjugated 270 kDa dextran coupled with HLA-A*0201 in complex with beta2microglobulin and the peptide RMISDQRANLGA (SEQ ID NO: 5127) derived from the antigen FlaB.
7. APC-SA conjugated 270 kDa dextran coupled with HLA-A*0201 in complex with beta2microglobulin and the peptide SQGGVNSPV (SEQ ID NO: 5112) derived from the antigen FlaB.
8. APC-SA conjugated 270 kDa dextran coupled with HLA-A*0201 in complex with beta2microglobulin and the peptide MLDEAKDKL (SEQ ID NO: 5516) derived from the antigen P37-42.
9. APC-SA conjugated 270 kDa dextran coupled with HLA-A*0201 in complex with beta2microglobulin and the peptide FMEQATNSWI (SEQ ID NO: 5530) derived from the antigen P37-42.
10. APC-SA conjugated 270 kDa dextran coupled with HLA-A*0201 in complex with beta2microglobulin and the peptide NLVFSSLFL (SEQ ID NO: 5510) derived from the antigen P37-42.
11. APC-SA conjugated 270 kDa dextran coupled with HLA-A*0201 in complex with beta2microglobulin and the peptide KLAESIYKRL (SEQ ID NO: 5531) derived from the antigen P37-42.
12. APC-SA conjugated 270 kDa dextran coupled with HLA-A*0201 in complex with beta2microglobulin and the nonsense peptide ALIAPVHAV (SEQ ID NO: 5913).

The binding of the above described MHC(peptide)/APC dextran can be used to determine the presence of OppA, DbpA, Flhf, FlaB and P37-42 specific T cells in the blood from Borrelia infected individuals by flow cytometry following a standard flow cytometry protocol.

Blood from a patient with Lyme disease is isolated and 100 ul of this blood is incubated with 10 µl of one of the MHC(peptide)/APC dextran constructs described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analysed on flow cytometer.

The presence of cells labelled with anti-CD3/PB, anti-CD8/PE and either of the MHC(peptide)/APC dextran constructs described above and thereby the presence of Borrelia specific T cells will indicate that the patient are infected with Borrelia bacteria. Blood analysed with MHC(peptide)/APC dextran construct 12 should show no staining of CD3 and CD8 positive cells with this MHC(peptide)/APC dextran construct.

The sensitivity of the above described diagnostic test may be enhanced by addition of labelled antibodies specific for activation markers expressed in or on the surface of the Borrelia specific T cells.

Example 42

This is an example of how MHC multimers may be used for diagnosis of Lyme Disease in blood samples from humans infected with Borrelia bacteria. The MHC multimer used are MHC complexes coupled to the multimerisation domain Streptavidin (SA). Lyme disease is caused by infection by Borrelia bacteria. During acute infection Borrelia specific activated T cells will be present in increased amounts in an activated state compared to healthy individuals. The presences of an increased amount of activated Borrelia specific T cells may thereby act as a surrogate marker for infection with Borrelia bacterium. MHC multimers carrying Borrelia specific antigenic peptides is in this example used to detect the presence of Borrelia specific T cells in the blood of patients infected with Borrelia.

Purified MHC-peptide complexes consisting of HLA-A*0201 heavy chain, human beta2microglobulin and peptide derived from regions in OppA (Table A), DbpA (Table B), Flhf (Table C), FlaB (Table D), and P37-42 (Table E) conserved among the three species Borrelia Burgdorferi, Borrelia Garinii and Borrelia Afzelii or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:
1. APC-SA coupled with HLA-A*0201 in complex with beta2microglobulin and the peptide YLNTKSNGNYEI (SEQ ID NO: 359) derived from the antigen OppA.
2. APC-SA coupled with HLA-A*0201 in complex with beta2microglobulin and the peptide FLSIFTQGYT (SEQ ID NO: 241) derived from the antigen OppA.
3. APC-SA coupled with HLA-A*0201 in complex with beta2microglobulin and the peptide GIYDLILNA (SEQ ID NO: 2761) derived from the antigen DbpA.
4. APC-SA coupled with HLA-A*0201 in complex with beta2microglobulin and the peptide YIKDINEFI (SEQ ID NO: 4479) derived from the antigen Flhf.
5. APC-SA coupled with HLA-A*0201 in complex with beta2microglobulin and the peptide IQIEIEQLTDEI (SEQ ID NO: 5126) derived from the antigen FlaB.
6. APC-SA coupled with HLA-A*0201 in complex with beta2microglobulin and the peptide RMISDQRANLGA (SEQ ID NO: 5127) derived from the antigen FlaB.
7. APC-SA coupled with HLA-A*0201 in complex with beta2microglobulin and the peptide SQGGVNSPV (SEQ ID NO: 5112) derived from the antigen FlaB.
8. APC-SA coupled with HLA-A*0201 in complex with beta2microglobulin and the peptide MLDEAKDKL (SEQ ID NO: 5516) derived from the antigen P37-42.

9. APC-SA coupled with HLA-A*0201 in complex with beta2microglobulin and the peptide FMEQATNSWI (SEQ ID NO: 5530) derived from the antigen P37-42.
10. APC-SA coupled with HLA-A*0201 in complex with beta2microglobulin and the peptide NLVFSSLFL (SEQ ID NO: 5510) derived from the antigen P37-42.
11. APC-SA coupled with HLA-A*0201 in complex with beta2microglobulin and the peptide KLAESIYKRL (SEQ ID NO: 5531) derived from the antigen P37-42.
12. APC-SA coupled with HLA-A*0201 in complex with beta2microglobulin and the non-sense peptide ALIAPVHAV (SEQ ID NO: 5913).

The binding of the above described MHC(peptide)/APC dextran can be used to determine the presence of OppA, DbpA, Flhf, FlaB and P37-42 specific T cells in the blood from Borrelia infected individuals by flow cytometry following a standard flow cytometry protocol.

Blood from a patient with Lyme disease is isolated and 100 ul of this blood is incubated with either of the four SA-MHC(peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analysed on flow cytometer.

The presence of cells labelled with anti-CD3/PB, anti-CD8/PE and either of the SA-MHC(peptide)/APC tetramers described above and thereby the presence of Borrelia specific T cells will indicate that the patient are infected with Borrelia bacteria. Blood analysed with SA-MHC(peptide)/APC tetramers 12 should show no staining of CD3 and CD8 positive cells with this SA-MHC(peptide)/APC tetramer.

The sensitivity of the above described diagnostic test may be enhanced by addition of labelled antibodies specific for activation markers expressed in or on the surface of the Borrelia specific T cells.

Example 43

This is an example of how MHC multimers may be used for diagnosis of Lyme Disease in blood samples from humans infected with Borrelia bacteria. The MHC multimer used MHC complexes coupled to any multimerization as described elsewhere herein. Lyme disease is caused by infection by Borrelia bacteria. During acute infection Borrelia specific activated T cells will be present in increased amounts in an activated state compared to healthy individuals. The presences of an increased amount of activated Borrelia specific T cells may thereby act as a surrogate marker for infection with Borrelia bacterium. MHC multimers carrying Borrelia specific antigenic peptides is in this example used to detect the presence of Borrelia specific T cells in the blood of a patient infected with Borrelia.

Purified MHC-peptide complexes consisting of HLA-A*0201 heavy chain, human beta2microglobulin and peptide derived from regions in OppA (Table A), DbpA (Table B), Flhf (Table C), FlaB (Table D), and P37-42 (Table E) conserved among the three species Borrelia Burgdorferi, Borrelia Garinii and Borrelia Afzelii or a negative control peptide were generated by in vitro refolding and purified or purified from antigen presenting cells. MHC-peptide complexes are then coupled to a multimerization domain together with APC.

The following MHC(peptide)/APC multimers are made:
APC-multimerisation domain coupled with HLA-A*0201 in complex with beta2microglobulin and the peptide YLNTKSNGNYEI (SEQ ID NO: 359) derived from the antigen OppA.
APC-multimerisation domain coupled with HLA-A*0201 in complex with beta2microglobulin and the peptide FLSIFTQGYT (SEQ ID NO: 241) derived from the antigen OppA.
APC-multimerisation domain coupled with HLA-A*0201 in complex with beta2microglobulin and the peptide GIYDLILNA (SEQ ID NO: 2761) derived from the antigen DbpA.
APC-multimerisation domain coupled with HLA-A*0201 in complex with beta2microglobulin and the peptide YIKDINEFI (SEQ ID NO: 4479) derived from the antigen Flhf.
APC-multimerisation domain coupled with HLA-A*0201 in complex with beta2microglobulin and the peptide IQIEIEQLTDEI (SEQ ID NO: 5126) derived from the antigen FlaB.
APC-multimerisation domain coupled with HLA-A*0201 in complex with beta2microglobulin and the peptide RMISDQRANLGA (SEQ ID NO: 5127) derived from the antigen FlaB.
APC-multimerisation domain coupled with HLA-A*0201 in complex with beta2microglobulin and the peptide SQGGVNSPV (SEQ ID NO: 5112) derived from the antigen FlaB
APC-multimerisation domain coupled with HLA-A*0201 in complex with beta2microglobulin and the peptide MLDEAKDKL (SEQ ID NO: 5516) derived from the antigen P37-42
APC-multimerisation domain coupled with HLA-A*0201 in complex with beta2microglobulin and the peptide FMEQATNSWI (SEQ ID NO: 5530) derived from the antigen P37-42.
APC-multimerisation domain coupled with HLA-A*0201 in complex with beta2microglobulin and the peptide NLVFSSLFL (SEQ ID NO: 5510) derived from the antigen P37-42.
APC-multimerisation domain coupled with HLA-A*0201 in complex with beta2microglobulin and the peptide KLAESIYKRL (SEQ ID NO: 5531) derived from the antigen P37-42.
APC-multimerisation domain coupled with HLA-A*0201 in complex with beta2microglobulin and the non-sense peptide ALIAPVHAV (SEQ ID NO: 5913).

The binding of the above described MHC(peptide)/APC multimers can be used to determine the presence of OppA, DbpA, Flhf, FlaB and P37-42 specific T cells in the blood from Borrelia infected individuals by flow cytometry following a standard flow cytometry protocol.

Blood from a patient with Lyme disease is isolated and 100 ul of this blood is incubated with either of the four MHC(peptide)/APC multimers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed.

The washing step is repeated. The washed cells are resuspended in 400-500 µl PBS; pH=7.2 and analysed on flow cytometer.

The presence of cells labelled with anti-CD3/PB, anti-CD8/PE and either of the MHC(peptide)/APC multimers described above and thereby the presence of *Borrelia* specific T cells will indicate that the patient are infected with *Borrelia* bacteria. Blood analysed with MHC(peptide)/APC multimer 12 should show no staining of CD3 and CD8 positive cells with this SA-MHC(peptide)/APC tetramer.

The sensitivity of the above described diagnostic test may be enhanced by addition of labelled antibodies specific for activation markers expressed in or on the surface of the *Borrelia* specific T cells.

Example 44

This is an example of how MHC multimers may be used for diagnosis of Lyme Disease in blood samples from humans infected with *Borrelia* bacteria. This is an example of indirect detection of individual specific T cells by measurement of produced soluble factor.

The MHC multimer used are antigen presenting cells expressing MHC molecules complexed with peptides derived from *Borrelia* antigen.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Activated effector T cells can be detected directly, via their secretion of cytokines, when presented with specific antigens. In this example the activation of individual effector T cells is detected by measurement of cytokines secreted from each individual T cell by capturing of the secreted cytokines in the proximity of each cell. The effector T cells secrete specific cytokine in response to stimulation by peptides from the *Borrelia* antigens OppA, DbpA, Flhf, FlaB and P37-42 when these peptides are presented by antigen presenting cells, briefly:

A patient's blood sample is collected ficoll purified using a Vacutainer® Cell Preparation Tubes™, which are spun to separate white blood cells, known as peripheral blood mononuclear cells (PBMCs)

PBMCs are washed in culture media to remove any background interference, counted to correct for a patient's immune status, and added in even amounts to the wells of a 96-well microtiter plate. These plate wells are pre-coated with a monoclonal antibody specific for the cytokine INFγ released by effector T cells in response to contact with specific antigens presented on antigen presenting cells (e.g. B cells that are a population in the PBMC pool).

The peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42)

from the *Borrelia* bacteria are added to the appropriate wells to stimulate cytokine release (positive and nil controls are used as internal assay controls). A negative control is a non-sense peptide unable to stimulate antigen-specific T cells.

The assay plate is placed in a $CO_2$ incubator overnight to allow the effector T cells to encounter the antigen.

The plates are washed, removing both the T cells and the antigen from the wells and leaving any T cell secreted cytokine captured by the antibodies lining the wells.

An enzyme-conjugated secondary antibody that binds to another epitope on the captured cytokine is then added and incubated for 1 hour at room temperature.

The plates are washed to remove unbound secondary antibody.

Coloured spots are generated by the conjugated enzyme upon application of a colorimetric substrate. These spots reveal a footprint of the antigen-specific effector T cells in the sample.

The spots are counted to determine the number of T cells in the sample that reacted to the antigen relative to the negative control, thereby identifying infection.

Example 45

This is an example of how MHC multimers may be used for diagnosis of Lyme Disease in blood samples from humans infected with *Borrelia* bacteria. This is an example of indirect detection of a population of specific T cells by measurement of produced soluble factor.

The MHC multimer used are antigen presenting cells expressing MHC molecules complexed with peptides derived from *Borrelia* antigen.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Activated effector T cells can be detected directly, via their secretion of cytokines, when presented with specific antigens. In this example the activation of a pool of effector T cells is detected by measurement of cytokines secreted from the activated T cells in the analysed sample. In this example the effector T cells secrete the cytokine INFγ in response to stimulation by peptides derived from the *Borrelia* antigens OppA, DbpA, Flhf, FlaB and P37-42 when these peptides are presented by antigen presenting cells. Briefly, the procedure is as follows: Blood is collected in a heparin-containing tube, then the sample is aliquoted into the wells of a microtiterplate. Appropriate wells are incubated with the peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO:

2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42)

from *Borrelia* bacteria within 12 hours of blood collection. Mix on a shaker, incubate for a day-ish. The supernatant plasma, is transferred to wells of another microtiterplate in various dilutions. The wells of the microtiterplate are previously coated with antibody specific for INFγ. An IFN-gamma standard dilution series is included as positive control. Mix, incubate, wash six times. An enzyme-conjugated secondary antibody that binds to another epitope on the captured INF is then added and incubated for 1 hour at room temperature Add enzyme substrate solution, incubate, add enzyme stopping solution. The OD of each well is determined. The OD value may be correlated to the amount of INF-gamma in the sample which is a surrogate marker for the presence of activated *Borrelia* specific T cells in the sample. The presence of activated *Borrelia* specific T cells in the sample is a surrogate marker for infection Example 46

This is an example of how MHC multimers may be used for diagnosis of Lyme Disease in blood samples from humans infected with *Borrelia* bacteria. The MHC multimer used are MHC complexes coupled to labelled dextran, where the MHC molecules are complexed with peptides derived from *Borrelia* antigen.

Lyme disease is caused by infection by *Borrelia* bacteria. During acute infection *Borrelia* specific activated T cells will be present in increased amounts in an activated state compared to healthy individuals. The presences of an increased amount of activated *Borrelia* specific T cells may thereby act as a surrogate marker for infection with *Borrelia* bacterium. MHC multimers carrying *Borrelia* specific antigenic peptides is in this example used to detect the presence of *Borrelia* specific T cells in the blood of a patient infected with *Borrelia*.

Activated effector T cells can be detected directly, via their production of cytokines, when presented with specific antigens. In this example the activation of individual effector T cells is detected by measurement of the intracellular production of cytokines in individual T cell in response to stimulation by peptides from the *Borrelia* antigen OppA, DbpA, Flhf, FlaB and P37-42 when these peptides are presented by antigen presenting cells.

Briefly, a patient's blood sample is collected ficoll purified using a Vacutainer® Cell Preparation Tubes™, which are spun to separate white blood cells, known as peripheral blood mononuclear cells (PBMCs)

PBMCs are washed in culture media to remove any background interference, counted to correct for a patient's immune status, and added in even amounts to the wells of cell culture plate.

The peptides YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42)

from the *Borrelia* bacteria are added to the appropriate wells to stimulate cytokine release (positive and nil controls are used as internal assay controls). A negative control is a non-sense peptide unable to stimulate antigen-specific T cells.

The assay plate is placed in a $CO_2$ incubator overnight to allow the effector T cells to encounter the antigen.

T cells from each well of the plate is transferred to 12×75 mm polystyrene test tubes and then analysed by flow cytometry using a procedure allowing for intracellular staining:

5 μl of each of the antibodies mouse-anti-human CD3/PB (clone UCHT1 from Dako) and mouse-anti-human CD8/PE (clone DK25 from Dako) are added to each sample and incubated for 20 minutes at room temperature in the dark. The samples are then washed by adding 2 ml PBS; pH=7.2 followed by centrifugation for 5 minutes at 200×g and the supernatant removed.

5 μl of each of the antibodies mouse-anti-human CD3/PB (clone UCHT1 from Dako) and mouse-anti-human CD8/PE (clone DK25 from Dako) are added to each sample and incubated for 20 minutes at room temperature in the dark. The samples are then washed by adding 2 ml PBS; pH=7.2 followed by centrifugation for 5 minutes at 200×g and the supernatant removed.

Fixative is added. Mix gently with a vortex mixer to ensure that the cells are in suspension.

Incubate in the dark at room temperature for 15 minutes. The samples are then washed by adding 2 ml PBS; pH=7.2 followed by centrifugation for 5 minutes at 200×g and then aspirate the supernatant, leaving approximately 50 μL of fluid. Mix thoroughly to ensure that the cells are in suspension.

Permeabilization reagent is added, to each test tube. Add an appropriate volume of fluorochrome-conjugated antibody specific for the intracellular antigen to be stained.

Mix gently to ensure that the cells are in suspension. Incubate in the dark at room temperature for 15 minutes. The samples are then washed by adding 2 ml PBS; pH=7.2 followed by centrifugation for 5 minutes at 200×g and the supernatant removed.

Resuspend the pellet in an appropriate fluid for flow cytometric analysis.

Analyse on a Flow Cytometer

The presence of cells labelled with anti-CD3/PB, anti-CD8/PE and the antibody used for intracellular staining are cells that have been activated by *Borrelia* antigens and are thereby *Borrelia* specific T cells. The presence of activated *Borrelia* specific T cells in the sample is a surrogate marker for infection.

The sensitivity of the above described diagnostic test may be enhanced by addition of fluorochrome labelled MHC multimers able to measure antigen-specific T cells and/or by addition of labelled antibodies specific for activation markers expressed in or on the surface of the *Borrelia* specific T cells.

Example 47

This is an example of a CTL killing assay.

T cell clones can be tested for specificity for a given *Borrelia* derived antigenic peptide able to bind a given HLA molecule using a CTL killing assay. In this example expanded T cell clones are tested for specificity for the *Borrelia* derived antigens OppA, DbpA, Flhf, FlaB and P37-42 by analysis in a standard 51-Cr release assay. For this purpose, T2 cells expressing HLA-A*0201 molecules on their surface are loaded with either YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42) and able to bind HLA-A*0201 or an irrelevant peptide ALIAPVHAV (SEQ ID NO: 5913) and used as target cells. CD8 T-cell clones that effectively lyse T2 cells pulsed with one of the abovementioned peptides without killing of T2 cells pulsed with the irrelevant peptide ALIAPVHAV (SEQ ID NO: 5913) are T cell clones specific for the specific epitope. Clones that do not show specific lysis against T2 cells pulsed with one of the abovementioned peptides are not specific for the corresponding antigen.

Example 48

This is an example of a CTL killing assay.

T cell clones can be tested for specificity for a given *Borrelia* derived antigenic peptide able to bind a given HLA molecule using a CTL killing assay. In this example expanded T cell clones are tested for specificity for any *Borrelia* derived protein by analysis in a standard 51-Cr release assay. For this purpose, T2 cells expressing HLA-A*0201 or any other cell type expressing specific HLA molecules are loaded with either antigenic peptides derived from *Borrelia* proteins and able to bind HLA molecules in question or an irrelevant peptide and used as target cells. CD8 T-cell clones that effectively lyse T2 cells pulsed with antigenic peptides derived from *Borrelia* proteins without killing of T2 cells pulsed with the irrelevant peptide are T cell clones specific for the tested *Borrelia* protein. Clones that do not show specific lysis against T2 cells pulsed with *Borrelia* derived antigenic peptide are not specific for the *Borrelia*-specific antigen in question.

Example 49

This is an example of how several *Borrelia* derived antigenic peptides can be used for vaccination of humans against Lyme disease.

In this example 10-20 different antigenic peptides with sequences derived from 1-20 different *Borrelia* proteins are used to generate a vaccine against Lyme disease. Each sequence is selected to be homologous among many *Borrelia* species and strains. Genes encoding the antigenic peptides with these sequences are synthesized, expressed and produced.

The antigenic peptides are used as vaccine components in humans to protect against *Borrelia burgdorferi, Borrelia Garinii* and/or *Borrelia afzelii* strains.

The antigenic peptides are given in doses suitable for humans and together with an adjuvant useful in humans. The vaccine is given either as a single dose or as multiple doses.

It is expected that vaccination with these antigenic peptides are effective against a challenge a wide range of *Borrelia* species and strain since these strains have homologous sequences of the amino acid sequence of the selected antigenic peptides. A multivalent vaccine comprising one or more types of *Borrelia* derived proteins should be enough to protect humans against most Lyme disease *Borrelia* strains. In general, any antigenic peptides comprising *Borrelia* derived amino acid sequences as described in the present application can be used.

Example 50

This is an example of how several *Borrelia* derived antigenic peptides can be used for vaccination of humans against Lyme disease.

In this example YLNTKSNGNYEI (SEQ ID NO: 359) (derived from the *Borrelia*-specific antigen OppA), FLSIFTQGYT (SEQ ID NO: 241) (derived from the *Borrelia*-specific antigen OppA), GIYDLILNA (SEQ ID NO: 2761) (derived from the *Borrelia*-specific antigen DbpA), YIKDINEFI (SEQ ID NO: 4479) (derived from the *Borrelia*-specific antigen Flhf), IQIEIEQLTDEI (SEQ ID NO: 5126) (derived from the *Borrelia*-specific antigen FlaB), RMISDQRANLGA (SEQ ID NO: 5127) (derived from the *Borrelia*-specific antigen FlaB), SQGGVNSPV (SEQ ID NO: 5112) (derived from the *Borrelia*-specific antigen FlaB), MLDEAKDKL (SEQ ID NO: 5516) (derived from the *Borrelia*-specific antigen P37-42), FMEQATNSWI (SEQ ID NO: 5530) (derived from the *Borrelia*-specific antigen P37-42), NLVFSSLFL (SEQ ID NO: 5510) (derived from the *Borrelia*-specific antigen P37-42), and KLAESIYKRL (SEQ ID NO: 5531) (derived from the *Borrelia*-specific antigen P37-42) are used to generate a vaccine against Lyme disease. Each sequence is selected to be homologous among many *Borrelia* species and strains.

Genes encoding the antigenic peptides with these sequences are synthesized, expressed and produced.

The antigenic peptides are used as vaccine components in humans to protect against *Borrelia burgdorferi, Borrelia Garinii* and/or *Borrelia afzelii* strains.

The antigenic peptides are given in doses suitable for humans and together with an adjuvant useful in humans. The vaccine is given either as a single dose or as multiple doses.

It is expected that vaccination with these antigenic peptides are effective against a challenge a wide range of *Borrelia* species and strain since these strains have homologous sequences of the amino acid sequence of the selected antigenic peptides. A multivalent vaccine comprising one or more types of *Borrelia* derived proteins should be enough to protect humans against most Lyme disease *Borrelia* strains. In general, any antigenic peptides comprising *Borrelia* derived amino acid sequences as described in the present application can be used.

SEQUENCE LISTING (5920 sequences)

SEQ ID NO: 1 - protein, 527 aa, BORRELIA AFZELLI.ACA-1
MKLQKLLFLIIFFLTFLCCNKEEKKEGVSFKISLGAEPSSLDPQLADDNVGSKMIDTMFKGLITGDPNTGGNKPGLAKSWDISPDGTVYTFTLREKIIWSDGVAITAEGIRKSYLRILNKETGSNYSEMVKSTIKNGQKYFDGQVSDSELGIRAIDEKTLEITLESPKPYFIDMLVHQSFIPIPIHIAEKYGQSWTNPENIVTSGPFKLKERIPNEKYVVEKNDKYYNSNQVEVQEITFYTTNDNSTAYKMYENGELDAIFSAIPPDLIKDLKLRSDYYSSAVNAIYFYAFNTHIKPLDNVKVRKALTLAIDRETLTYKVLDDGTTPTRRITPNFSSYSYAKNLELFNPEIAKTLLAEAGYPNGNGFPILKLKYNTSEAHKKICEFIQNQWKKILNIDVELENEEWTTYLNTKSNGNYEIARAGWIGDYADPLTFLSIFTQGYTQFSSHNYSSPEYNELIKKSDLELDPIKRQDILRKAEEIIIEKDFPIAPIYIYGNSYLFRNDKWTGWNTNITERFDLSQLKLKK

SEQ ID NO: 2 - protein, 528 aa, BORRELIA AFZELLI.PKO
MKLQKLLFLIIFFLTFLCCNKEEKKEGVSFKISLGAEPSSLDPQLADDNVGSKMIDTMFKGLITGDPNTGGNKPGLAKSWDISPDGTVYTFTLREKIIWSDGVAITAEGIRKSYLRILNKETGSNYSEMVKSTIKNGQKYFDGQVSDSELGIRAIDEKTLEITLESPKPYFIDMLVHQSFIPIPIHIAEKYGQSWTNPENIVTSGPFKLKERIPNEKYVVEKNDKYYNSNQVEVQEITFYTTNDNSTAYKMYENGELDAIFSAIPPDLIKDLKLRSDYYSSAVNAIYFYAFNTHIKPLDNVKVRKALTLAIDRETLTYKVLDDGTTPTRRITPNFSSYSYAKNLELFNPEIAKTLLAEAGYPNGNGFPILKLKYNTSEAHKKICEFIQNQWKKILNIDVELENEEWTTYLNTKSNGNYEIARAGWIGDYADPLTFLSILTHGYTQFSSHNYSSPEYNELIKKSDLELDPIKRQDILRKAEEIIIEKDFPIAPIYIYGNSYLFRNDKWTGWNTNITERFDLSQLKLKNK

SEQ ID NO: 3 - protein, 527 aa, BORRELIA AFZELLI.HLJ01
MKLQKLLFLIIFFLTFLCCNKEEKKEGVSFKISLGAEPSSLDPQLADDNVGSKMIDTMFKGLITGDPNTGGNKPGLAKSWDISPDGTVYTFTLREKIIWSDGVAITAEGIRKSYLRILNKETGSNYSEMVKSTIKNGQKYFDGQVSDSELGIRAIDEKTLEITLESPKPYFIDMLVHQSFIPIPIHIAEKYGQSWTNPENIVTSGPFKLKERIPNEKYVVEKNDKYYNSNQVEVQEITFYTTNDNSTAYKMYENGELDAIFSAIPPDLIKDLKLRSDYYSSAVNAIYFYAFNTHIKPLDNVKVRKALTLAIDRETLTYKVLDDGTTPTRRITPNFSSYSYAKNLELFNPEIAKTLLAEAGYPNGNGFPILKLKYNTSEAHKKICEFIQNQWKKILNIDVELENEEWTTYLNTKSNGNYEIARAGWIGDYADPLTFLSIFTHGYTQFSSHNYSSPEYNELIKKSDLELDPIKRQDILRKAEEIIIEKDFPIAPIYIYGNSYLFRNDKWTGWNTNITERFDLSQLKLKK

SEQ ID NO: 4 - protein, 528 aa, BORRELIA GARINII.PBI
MKLQKLLFSVIFFLTFLCCNKEEKKEGISFKISLGSEPSSLDPQLADDNVGSKMIDTMFRGLITGDPNTGGNKPGLAKSWDISPDGTVYTFTLREKIIWSDGVAITAEGIRKSYLRILNKETGSNYAEMVKSTIKNGQKYFDGQVSDSELGIRAIDEKTLEITLESPKPYFIDMLVHQSFIPIPIHIAEKYGQSWTSPENIVTSGPFKLKERIPNEKYVVEKNDKYYNSNQVEVQEITFYTTNDSSTAYKMYENKELDAIFGSIPPDLIKDLKLRSDYYSSAVNAIYFYAFNTYIKPLDNVKVRKALTLAIDRETLTYKVLDNGTTPTRRIAPNFSSYSYAKNLELFNPEIAKTLLAEAGYPNGNGFPILKLKYNTSEAHKKICEFIQNQWKKILNIDVELENEEWTTYLNTRSNGNYEIARAGWIGDYADPLTFLSIFTQGYTQFSSHNYSSPEYNELIKKSDLELDPIKRQDILRKAEEIIIEKDFPIAPIYIYGNSYLFRNDKWTGWNTNITERFDLSQLKLKNK

SEQ ID NO: 5 - protein, 527 aa, BORRELIA GARINII.PBR
MKLQKSLFLIIFFLTFLCCSKEKAKEGVSFKISLGSEPSSLDPQLAEDNVASKMIDTMFRGLITGDPNTGGNRPGLAKSWNISPDGTVYTFTLREKITWSDGVAITAEGIRKSYLRILNKETGSKYVEMVKSAIKNGQKYFDEQVPDSEVGIRAIDEKTLEITLESPKPYFIDMLVHQSFIPIPIHVTEKYGQSWTSPENMVTSGPFKLKERIPNEKYVVEKNDKYYNSNEVEVQEITFYTTNDSSTAYKMYENKELDAIFVSIPPDLIKDLKLRNDYYSSAVNAIYFYAFNTTVKPLDNVKVRKALTLAIDRETLTYKVLDNGTTPTRRATPNFSSYSYAKNLELFNPEIAKTLLAEAGYPNGNGFPILKLKYNTSDANKKICEFIQNQWKKNLNIDVELENEEWTTYLNTKSNGNYEIARAGWIGDYADPATFLSIFTQGYTQFSSHNYSNSEYNELIKKSDLELDPIKRQDILRQAEEIIIEKDFPIAPIYIYGNSYLFRNDKWTGWNTNISERFDLSQLKLKK

SEQ ID NO: 6 - protein, 528 aa, BORRELIA GARINII.NMJW1
MKLQKSLLFLIIFFLTFLCCSKEKAKEGVSFKISLGSEPSSLDPQLAEDNVASKMIDTMFRGLITGDPKTGGNRPGLAKSWDISSDGTVYTFTLREKITWSDGVPITAEGIRKSYLRILNKETGSKYVEMVKSAIKNGQKYFDEQVPDSEVGIRAIDEKTLEITLESPKPYFIDMLVHQSFIPIPIHVTEKYGQSWTSPENMVTSGPFKLKERIPNEKYVFEKNDKYYNSSEVEVQEIAFYTTNDSSTAYKMYENEELDAIFGSIPPDLIKDLKLRSDYYSSAVNAIYFYAFNTKVRPLDNVKVRKALTLAIDRETLAYKVLDNGTTPTRRATPNFSSYSYAKNLELFNPEIAKTLLAEAGYPNGNGFPILKLKYNTSDANKKICEFIQNQWKKNLNIDVELENEEWTTYLNTKANGNYEIARAGWIGDYADPATFLSIFTQGYTQFSSHNYSNSEYNELIKKSDLELDPIKRQDILRQAEEIIIEKDFPIAPIYIYGNSYLFRNDKWTGWNTNISERFDLSQLKLKK

SEQ ID NO: 7 - protein, 528 aa, BORRELIA BURGDORFERI.JD1
MKLQRSLFLIIFFLTFLCCNNKERKEGVSFKISLGAEPSSLDPQLAEDNVASKMIDTMFRGIVTGDPNTGGNKPGLAKGWDISSDGTVYTFNLREKITWSDGVAITAEGIRKSYLRILNKETGSKYVEMVKSVIKNGQKYFDGQVTDSELGIRAIDEKTLEITLESPKPYFIDMLVHQSFIPVPVHVTEKYGQNWTSPENMVTSGPFKLKERIPNEKYVFEKNNKYYDSNEVELEEITFYTTNDSSTAYKMYENEELDAIFGSIPPDLIKNLKLRSDYYSSAVNAIYFYAFNTHIKPLDNVKIRKALTLAIDRETLTYKVLDNGTTPTRRATPNFSSYSYAKSLELFNPEIAKTLLAEAGYPNGNGFPILKLKYNTNEANKKICEFIQNQWKKNLNIDVELENEEWTTYLNTKANGNYEIARAGWIGDYADPLTFLSIFTQGYTQFSSHNYSNPEYNELIKKSDLELDPIKRQDILRQAEEIIIEKDFPIAPIYIYGNSYLFRNDKWTGWNTNILERFDLSQLKLKNK

SEQ ID NO: 8 - protein, 542 aa, BORRELIA BURGDORFERI.LF7A
MKSQSRTNFTLSLLTAGILCASAASQAANVPAGTQLAEKQELVRNNGNEPASLDPHKVESDVEFNILSDLFEGLVNVSPTGEIQPRLAEKWENKDNTVWTFHLRPGITWSDGTAITAQDVVWSWQRLVDPKTASPYASYPGNMHIVNGAAIAQGKQAPDTLGVKALNDTTLEVTLTQPNAAFLAMLAHPSMVPVDKVLINRFGEKWTKPEHLVTSGAYKLSQWVVNERIVAERNPRYWDNAHTVINKVTYLPITSEAADVNRYKAGEIDIVYTVPINQFAQLKKTMGTQLDVSPQLATYYYEFNTTRPPFNDVRVRKALNMALDKDIIADKVLGQGQRPAWLISQPDIGGVTLKTPDYASWPMDKRIAEAKKLLEEAGFNASHPLSFNLLYNTSESHQRIAIAASSMWKKNLGVEAKLQNQEWKTMLDTMHTHNFDAVRYAWIADYDDAATFLNNFRTGDSENTSQYSNPDYDQALVNAAKAKTTQERGQFYQQAEDLLGRDVPAIPVYHYVRTHLVKPWVGGFTPDKLGYYYTKDMYIKKH

SEQ ID NO: 9 - protein, 528 aa, BORRELIA BURGDORFERI.ZS7
MKLQKLLFLIIFFLTFLCCNKEEKKEGVSFKISLGAEPSSLDPQLADDNVGSKMIDTMFKGLITGNPNTGGNKPGLAKGWDISSDGTVYTFNLREKITWSDGVAITAEGIRKSYLRILNKETGSKYVEMVKSVIKNGQKYFDGQVTDSELGIRAIDEKTLEITLESPKPYFIDMLVHQSFIPVPVHVTEKYGQNWTSPENMVTSGPFKLKERIPNEKYVFEKNNKYYDSNEVELEEITFYTTNDSSTAYKMYENEELDAIFGSIPPDLIKNLKLRSDYYSSAVNAIYFYAFNTHIKPLDNVKIRKALTLAIDRETLTYKVLDNGTTPTRRATPNFSSYSYAKSLELFNPEIAKTLLAEAGYPNGNGFPILKLKYNTNEANKKICEFIQNQWKKNLNIDVELENEEWTTYLNTKANGNYEIARAGWIGDYADPLTFLSIFTQGYTQFSSHNYSNPEYNELIKKSDLELDPIKRQDILRQAEEIIIEKDFPIAPIYIYGNSYLFRNDKWTGWNTNILERFDLSQLKLKNK

SEQ ID NO: 10 - protein, 170 aa, BORRELIA AFZELLI.PKO
MIKYNKIILTLTLLASLLAACSLTGKARLESSVKDITNEIEKAIKEAEDAGVKTDAFTETQTGGKVAGPKIRAAKIRVADLTIKFLEATEEETITFKENGAGEDEFSGIYDLILNAAKAVEKIGMKDMTKTVEEAAKENPKTTANGIIEIVKVMKAKVENIKEKQTKNQK

SEQ ID NO: 11 - protein, 170 aa, BORRELIA AFZELLI.ACA-1
MIKYNKIILTLTLLASLLAACSLTGKARLESSVKDITNEIEKAIKEAEDAGVKTDAFTETQTGGKVGGSQIRAAKIRVADLTIKFLEATEEETITFKENGAGEEDFSGIYDLILNAAKAVEKIGMQGMKQAVEEAAKEKPKTTADGIIAIVKVMKAKVENIKEKQTKNQK

SEQ ID NO: 12 - protein, 170 aa, BORRELIA AFZELLI.A91; identical to SEQ ID NO: 11

SEQ ID NO: 13 - protein, 184 aa, BORRELIA AFZELLI.U01
MTKHTKNLIKLSLIVSLLVACDLTGETKIKLESSAQEIKDEINKIKANAKKEGVNFEAFTDKQTGSKVSKKPEFILKAKIQAIQVAGKFVKAIKEEAEKLKKSGSSGAFSAMYDLMLDVSKPLEEIGIQKMTGTVTQAAEKTPPTTAEGILAIAKAMEDKLNNVNTKQHEALKNLEGKEAKTPK

SEQ ID NO: 14 - protein, 175 aa, BORRELIA GARINII.PBI
MTKYIKNLLKLTLIVGLLVACSLTGKARLESSVKDITDEIDKAIKEAIADGVKLNELEENKTGAKKGGPQIRDAKIRVINLSVKFLKEIEEEANILKDNVGMNKVDKDQLLKDMYDLMLNAAGSLQKLGLQEMIKTVTQAAEKTPPTTVEGILMIANTIEDKLKKIKGKQETNKK

SEQ ID NO: 15 - protein, 164 aa, BORRELIA GARINII.PREF
MTKYIKKNLLKLSLIVSLLVACGLTGETKIRLESSAQEIKDEINKIKANAKKEGVKFEAFTDKQTGSKVSEKPEFILKAKIQAIQVAEKFVKAIKEEAEKLKKSGSSGAFSAMYDLMLDVSKPLEEIGIQKMTGTVTQVAEKTPATTAEGILAIAQAMEDKLKN

SEQ ID NO: 16 - protein, 169 aa, BORRELIA GARINII.VS461
MIKYNKIILTLTLLASLLAACSLTGKARLESSVKDITNEIDKAIKAAKDAGVNTDAFTETQTGGKVAGSQIRDAKKLVADLTIEFLKATEEETITFKENGAGEDEFSGIYDLIYRTAEAVEKIGMKVKQAVEDTAKENPKTTANGIIAIVKVMKAKVENIKEKQTKNQK

SEQ ID NO: 17 - protein, 186 aa, BORRELIA GARINII.S40
MTKYIKKNLLKLSLIVSLLVACGLTGETKIRLESSAQEIKDEINKIKANAKKEGVKFEAFTDKQTGSKVSEKPEFILKAKIKAIQVAEKFVKAIKEEAEKLKKSGSSGAFSAMYDLMLDVSKPLEEIGIQKMTGTVTKEAEKTPPTTAEGILAIAQAMEEKLNNVNKKQQDALKNLEEKANTAATT

SEQ ID NO: 18 - protein, 191 aa, BORRELIA BURGDORFERI.B31
MIKCNNKTFNNLLKLTILVNLLISCGLTGATKIRLERSAKDITDEIDAIKKDAALKGVNFDAFKDKKTGSGVSENPFILEAKVRATTVAEKFVIAIEEEATKLKETGSSGEFSAMYDLMFEVSKPLQKLGIQEMTKTVSDAAEENPPTTAQGVLEIAKKMREKLQRVHTKNYCTLKKKENSTFTDEKCKNN

SEQ ID NO: 19 - protein, 124 aa, BORRELIA BURGDORFERI.PMAI
LTGKARLESSVKDITNEIDKAIKEAQEGGVDTNAFTDQKTGAKMGGPKTREAKLRIIALTLQFLKETKEEAIKLKEYGAGEDEFKELYELMLKISKAVEGIGIQNMTATVSMGIVENPPTTAQG

SEQ ID NO: 20 - protein, 187 aa, BORRELIA BURGDORFERI.CA-11.2A
MIKCNNKTFNNLLKLTILVNLLISCGLTGATKIKLESSAKAIVDEIDAIKKEAASMGVNFDAFTDSATGGKVARSGSESRAGNFIKQAKVRAIDTAEKFLTAIEEEATKLKETGSSGEFSAMYDLMFEVSKPLQELGIQDMTKEVSDAAKENPPTTAQGVLEIAKKMREKLIRVKGKQKLNPETNKQ

SEQ ID NO: 21 - protein, 388 aa, BORRELIA AFZELLI.ACA-1
MVQYFTEKGPTYNEVIEIIKKKYGKNARVMTYKTIPHGGILGLFSKDWVEVSGYVRYDIGNQQINVEDEKRKILQSIKREENSSIEDVLKEVKSLKTELAHKKENINHPTITKIEDILRENDFSENYIKDINEFIKREFSLSDLDDYERVREDVVLYIAKTIKCSGSIIDDLKKRVFILVGPTGVGKTTTIAKLAAIYGINGESKSLNIKIITIDNYRIGAKKQIQTYGDIMGIPVRAIESFKDLKDEITDSKDFDLILVDTIGKSPKDFMKLAEMKELLNACGRDAEFHLAVSSTTKTSDVKEIFHQFSPFNYKTVIFTKVDETTCVGNLISLIYEMKKVVSYVTDGQIVPHNISVAEPLTFIRRINGYRISDDAEFIKKIKSKSYY

SEQ ID NO: 22 - protein, 388 aa, BORRELIA AFZELLI.PKO; identical to SEQ ID NO: 21

SEQ ID NO: 23 - protein, 388 aa, BORRELIA GARINII.FAR04
MVQYFTEKGPTYNEVIEIIKKKYGKNARVMTYKTVPHGGILGLFSKDWVEVSGYVRYDIGNQQINVEDEKRKILQSIKREENSSIEDVLKEVKSLKTELAHKKENINHPTITKIEDILRENDFSENYIKDINEFIKREFSLSDLDDYERVREDVVLYIAKTIKCSGSIIDDLKKRVFILVGPTGVGKTTTIAKLAAIYGINGESKSLNIKIITIDNYRIGAKKQIQTYGDIMGIPVRAIESFKDLKDEITDSKDFDLILVDTIGKSPKDFMKLAEMKELLNACGRDAEFHLAVSSTTKTSDVKEIFHQFSPFNYKTVIFTKVDETTCVGNLISLIYEMKKVVSYVTDGQIVPHNISVAEPLTFIRRINGYRISDDAEFIKKIKSKSYY

SEQ ID NO: 24 - protein, 388 aa, BORRELIA GARINII.PBI; identical to SEQ ID NO: 23

SEQ ID NO: 25 - protein, 388 aa, BORRELIA GARINII.PBR; identical to SEQ ID NO: 23

SEQ ID NO: 26 - protein, 388 aa, BORRELIA BURGDORFERI.B31
MVQYFTEKGPTYNEVIEIIKKKYGKNARVMTYKTVPHGGILGLFSKDWVEVSGYVRYDIGNQQINVEDEKRKILQSIKREENSSIEDVLKEVKSLKTELAHKKENINHPTITKIEDILRENDFSENYIKDINEFIKREFSLSDLDDYERVREDVVLYIAKTIKCSGSIIDNLKKRVFILVGPTGVGKTTTIAKLAAIYGINGESKSLNIKIITIDNYRIGAKKQIQTYGDIMGIPVRAIESFKDLKDEITDSKDFDLILVDTIGKSPKDFMKLAEMKELLNACGRDAEFHLAVSSTTKTSDVKEIFHQFSPFNYKTVIFTKVDETTCVGNLISLIYEMKKVVSYVTDGQIVPHNISVAEPLTFIRRINGYRISDDAEFIKKIKSKSYY

SEQ ID NO: 27 - protein, 388 aa, BORRELIA BURGDORFERI.N40; identical to SEQ ID NO: 26

SEQ ID NO: 28 - protein, 388 aa, BORRELIA BURGDORFERI.ZS7; identical to SEQ ID NO: 26

SEQ ID NO: 29 - protein, 336 aa, BORRELIA AFZELLI.PKO
MIINHNTSAINASRNNAINAANLSKTQEKLSSGYRINRASDDAAGMGVSGKINAQIRGLSQASRNTSKAINFIQTTEGNLNEVEKVLVRMKELAVQSGNGTYSDSDRGSIQIEIEQLTDEINRIADQAQYNQMHMLSNKSASQNVKTAEELGMQPAKINTPASLSGSQASWTLRVHVGANQDEAIAVNIYSANVANLFAGEGAQAAQAAPVQEGAQEEGAQQPTPATAPTQGGVNSPVNVTTTVDANTSLAKIENAIRMISDQRANLGAFQNRLESIKNSTEYAIENLKASYAQIKDATMTDEVVAATTNSILTQSAMAMIAQANQVPQYVLSLLR

SEQ ID NO: 30 - protein, 336 aa, BORRELIA AFZELLI.9W10-04; identical to SEQ ID NO: 29

SEQ ID NO: 31 - protein, 336 aa, BORRELIA AFZELLI.P-GAU
MIINHNTSAINASRNNAINAANLSKTQEKLSSGYRINRASDDAAGMGVSGKINAQITGLSQASRNTSKAINFIQTTEGNLNEVEKVLVRMKELAVQSGNGTYSDADRGSIQIEIEQLTDEINRIADQAQYNQMHMLSNKSASQNVKTAEELGMQPAKINTPASLSGSQASWTLRVHVGANQDEAIAVNIYSANVANLFAGEGAQAAQAAPVQEGAQEEGAQQPTPATAPTQGGVNSPVNVTTTVDANTSLAKIENAIRMISDQRANLGAFQNRLESIKNSTEYAIENLKASYAQIKDATMTDEVVAATTNSILTQSAMAMIAQANQVPQYVLSLLR

SEQ ID NO: 32 - protein, 329 aa, BORRELIA AFZELLI.VS461
MIINHNTSAINASRNNAINAANLSKTQEKLSSGYRINRASDDAAGMGVSGKINAQIRGLSQASRNTSKAINFIQTTEGNLNEVEKVLVRMKELAVQSGNGTYSDSDRGSIQIEIEQLTDEINRIADQAQYNQMHMLSNKSASQNVKTAEELGMQPAKINTPASLSGSQASWTLRVHVGANQDEAIAVNIYSANVANLFAGEGAQAAQAAPVQEGAQEEGAQQPTPATAPTQGGVNSPVNVTTTVDANTSLAKIENAIRMISDQRANLGAFQNRLESIKNSTEYAIENLKASYAQIKDATMTDEVVAATTNSILTQSAMAMIAQANQVPQ

SEQ ID NO: 33 - protein, 336 aa, BORRELIA GARINII.PBI
MIINHNTSAINASRNNSINAANLSKTQEKLSSGYRINRASDDAAGMGVSGKINAQIRGLSQASRNTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGSQAAQTAPVQEGAQQEGAQQPAPATAPSQGGVNSPVNVTTTVDANTSLAKIENAIRMISDQRANLGAFQNRLESIKDSTEYAIENLKASYAQIKDATMTDEVVASTTNSILTQSAMAMIAQANQVPQYVLSLLR

SEQ ID NO: 34 - protein, 336 aa, BORRELIA GARINII.BGVIR
MIINHNTSAINASRNNGINAANLSKTQEKLSSGYRINRASDDAAGMGVSGKINAQIRGLSQASRNTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGAQAAQTAPVQEGAQQEGAQQPAPATAPSQGGVNSPVNVTTTVDANTSLAKIENAIRMISDQRANLGAFQNRLESIKDSTEYAIENLKASYAQIKDATMTDEVVAATTNSILTQSAMAMIAQANQVPQYVLSLLR

SEQ ID NO: 35 - protein, 329 aa, BORRELIA GARINII.20047
MIINHNTSAINASRNNGINAANLSKTQEKLSSGYRINRASDDAAGMGVSGKINAQIRGLSQASRNTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGAQAAQTAPVQEGAQQEGAQQPAPATAPSQGGVNSPVNVTTTVDANTSLAKIENAIRMISDQRANLGAFQNRLESIKDSTEYAIENLKASYAQIKDATMTDEVVAATTNSILTQSAMAMIAQANQVPQ

SEQ ID NO: 36 - protein, 199 aa, BORRELIA BURGDORFERI.A1
NTSKAINFIQTTEGNLNEVEKVLVRMKELAVQSGNGTYSDADRGSIQIEIEQLTDEINRIADQAQYNQMHMLSNKSASQNVRTAEELGMQPAKINTPASLSGSQASWTLRVHVGANQDEAIAVNIYAANVANLFSGEGAQTAQAAPVQEGVQQEGAQQPAPATAPSQGGVNSPVNVTTTVDANTSLAKIENAIRMISDQ

SEQ ID NO: 37 - protein, 213 aa, BORRELIA BURGDORFERI.CA8
ADRGSIQIEIEQLTDEINRIADQAQYNQMHMLSNKSASQNVRTAEELGMQPAKINTPASLSGSQASWTLRVHVGANQDEAIAVNIYAANVANLFSGEGAQTAQAAPVQEGVQQEGAQQPAPATAPSQGGVNSPVNVTTTVDANTSLAKIENAIRMISDQRANLGAFQNRLESIKDSTEYAIENLKASYAQIKDATMTDEVVAATTNSILTQSA

SEQ ID NO: 38 - protein, 328 aa, BORRELIA GARINII P37 noname
MRLCLIKIFIIPNLVFSSLFLFESCSGFLSKKSIEQFALALKDHQENKNTTNTSADKNSKEIESPKDVTSSNKKTYDPILQVGSNQHMSDDPGANNKESLPNSSPAIIQNDSHAQNNVKMEENKSTTPQHDPIEQSNFKNSLTTTSKTPAIPSEEEIKANLDEFAQEEYEQTSLSEIKNATQIVNHANPENKLNNTLLEFEKDYETLSNLLFSNLDTSPLNRKIKTIMPKLQEMRSFMEQATNSWISAKGMLDEAKDKLAESIYKRLYNGNSYRFGGSFNGRDMQHAKNLAYRAIDFASACIEYTQKAIDYLQQGNSCKKEIENIFKL

SEQ ID NO: 39 - protein, 328 aa, BORRELIA BURGDORFERI P37 noname; identical to SEQ ID NO: 38

SEQ ID NO: 40 - protein, 9 aa, BORRELIA OppA
WSDGVAITA

SEQ ID NO: 41 - protein, 9 aa, BORRELIA OppA
TTNDNSTAY

SEQ ID NO: 42 - protein, 9 aa, BORRELIA OppA
RSDYYSSAV

SEQ ID NO: 43 - protein, 9 aa, BORRELIA OppA
YSSAVNAIY

SEQ ID NO: 44 - protein, 9 aa, BORRELIA OppA
AIDRETLTY

SEQ ID NO: 45 - protein, 9 aa, BORRELIA OppA
FLSIFTQGY

SEQ ID NO: 46 - protein, 9 aa, BORRELIA OppA
YTQFSSHNY

SEQ ID NO: 47 - protein, 9 aa, BORRELIA OppA
FLSILTHGY

SEQ ID NO: 48 - protein, 9 aa, BORRELIA OppA
FLSIFTHGY

SEQ ID NO: 49 - protein, 9 aa, BORRELIA OppA
TTNDSSTAY

SEQ ID NO: 50 - protein, 9 aa, BORRELIA OppA
WSDGVPITA

SEQ ID NO: 51 - protein, 9 aa, BORRELIA OppA
AIDRETLAY

SEQ ID NO: 52 - protein, 9 aa, BORRELIA OppA
LSDLFEGLV

SEQ ID NO: 53 - protein, 9 aa, BORRELIA OppA
WSDGTAITA

SEQ ID NO: 54 - protein, 9 aa, BORRELIA OppA
VSPQLATYY

SEQ ID NO: 55 - protein, 9 aa, BORRELIA OppA
TSQYSNPDY

SEQ ID NO: 56 - protein, 9 aa, BORRELIA OppA
TTQERGQFY

SEQ ID NO: 57 - protein, 9 aa, BORRELIA OppA
FTPDKLGYY

SEQ ID NO: 58 - protein, 10 aa, BORRELIA OppA
YTTNDNSTAY

SEQ ID NO: 59 - protein, 10 aa, BORRELIA OppA
TTNDNSTAYK

SEQ ID NO: 60 - protein, 10 aa, BORRELIA OppA
LRSDYYSSAV

SEQ ID NO: 61 - protein, 10 aa, BORRELIA OppA
YYSSAVNAIY

SEQ ID NO: 62 - protein, 10 aa, BORRELIA OppA
YSSAVNAIYF

SEQ ID NO: 63 - protein, 10 aa, BORRELIA OppA
SSAVNAIYFY

SEQ ID NO: 64 - protein, 10 aa, BORRELIA OppA
LAIDRETLTY

SEQ ID NO: 65 - protein, 10 aa, BORRELIA OppA
ITPNFSSYSY

SEQ ID NO: 66 - protein, 10 aa, BORRELIA OppA
YLNTKSNGNY

SEQ ID NO: 67 - protein, 10 aa, BORRELIA OppA
TFLSIFTQGY

SEQ ID NO: 68 - protein, 10 aa, BORRELIA OppA
GYTQFSSHNY

SEQ ID NO: 69 - protein, 10 aa, BORRELIA OppA
TFLSILTHGY

SEQ ID NO: 70 - protein, 10 aa, BORRELIA OppA
TFLSIFTHGY

SEQ ID NO: 71 - protein, 10 aa, BORRELIA OppA
YTTNDSSTAY

SEQ ID NO: 72 - protein, 10 aa, BORRELIA OppA
TTNDSSTAYK

SEQ ID NO: 73 - protein, 10 aa, BORRELIA OppA
YLNTRSNGNY

SEQ ID NO: 74 - protein, 10 aa, BORRELIA OppA
ATPNFSSYSY

SEQ ID NO: 75 - protein, 10 aa, BORRELIA OppA
SSHNYSNSEY

SEQ ID NO: 76 - protein, 10 aa, BORRELIA OppA
YVFEKNDKYY

SEQ ID NO: 77 - protein, 10 aa, BORRELIA OppA
LAIDRETLAY

SEQ ID NO: 78 - protein, 10 aa, BORRELIA OppA
YLNTKANGNY

SEQ ID NO: 79 - protein, 10 aa, BORRELIA OppA
YVFEKNNKYY

SEQ ID NO: 80 - protein, 10 aa, BORRELIA OppA
ILSDLFEGLV

SEQ ID NO: 81 - protein, 10 aa, BORRELIA OppA
LVDPKTASPY

SEQ ID NO: 82 - protein, 10 aa, BORRELIA OppA
TSEAADVNRY

SEQ ID NO: 83 - protein, 10 aa, BORRELIA OppA
VSPQLATYYY

SEQ ID NO: 84 - protein, 10 aa, BORRELIA OppA
HTHNFDAVRY

SEQ ID NO: 85 - protein, 10 aa, BORRELIA OppA
NTSQYSNPDY

SEQ ID NO: 86 - protein, 10 aa, BORRELIA OppA
GFTPDKLGYY

SEQ ID NO: 87 - protein, 10 aa, BORRELIA OppA
FTPDKLGYYY

SEQ ID NO: 88 - protein, 11 aa, BORRELIA OppA
FYTTNDNSTAY

SEQ ID NO: 89 - protein, 11 aa, BORRELIA OppA
YTTNDNSTAYK

SEQ ID NO: 90 - protein, 11 aa, BORRELIA OppA
DYYSSAVNAIY

SEQ ID NO: 91 - protein, 11 aa, BORRELIA OppA
YSSAVNAIYFY

SEQ ID NO: 92 - protein, 11 aa, BORRELIA OppA
TLAIDRETLTY

SEQ ID NO: 93 - protein, 11 aa, BORRELIA OppA
LTFLSIFTQGY

SEQ ID NO: 94 - protein, 11 aa, BORRELIA OppA
FSSHNYSSPEY

SEQ ID NO: 95 - protein, 11 aa, BORRELIA OppA
LTFLSILTHGY

SEQ ID NO: 96 - protein, 11 aa, BORRELIA OppA
LTFLSIFTHGY

SEQ ID NO: 97 - protein, 11 aa, BORRELIA OppA
FYTTNDSSTAY

SEQ ID NO: 98 - protein, 11 aa, BORRELIA OppA
YTTNDSSTAYK

SEQ ID NO: 99 - protein, 11 aa, BORRELIA OppA
ATFLSIFTQGY

SEQ ID NO: 100 - protein, 11 aa, BORRELIA OppA
FSSHNYSNSEY

SEQ ID NO: 101 - protein, 11 aa, BORRELIA OppA
TLAIDRETLAY

SEQ ID NO: 102 - protein, 11 aa, BORRELIA OppA
LAIDRETLAYK

SEQ ID NO: 103 - protein, 11 aa, BORRELIA OppA
FSSHNYSNPEY

SEQ ID NO: 104 - protein, 11 aa, BORRELIA OppA
RLVDPKTASPY

SEQ ID NO: 105 - protein, 11 aa, BORRELIA OppA
LVDPKTASPYA

SEQ ID NO: 106 - protein, 11 aa, BORRELIA OppA
ITSEAADVNRY

SEQ ID NO: 107 - protein, 11 aa, BORRELIA OppA
QLDVSPQLATY

SEQ ID NO: 108 - protein, 11 aa, BORRELIA OppA
ASHPLSFNLLY

SEQ ID NO: 109 - protein, 11 aa, BORRELIA OppA
ENTSQYSNPDY

SEQ ID NO: 110 - protein, 11 aa, BORRELIA OppA
YSNPDYDQALV

SEQ ID NO: 111 - protein, 11 aa, BORRELIA OppA
GFTPDKLGYYY

SEQ ID NO: 112 - protein, 11 aa, BORRELIA OppA
FTPDKLGYYYT

SEQ ID NO: 113 - protein, 12 aa, BORRELIA OppA
TFYTTNDNSTAY

SEQ ID NO: 114 - protein, 12 aa, BORRELIA OppA
FYTTNDNSTAYK

SEQ ID NO: 115 - protein, 12 aa, BORRELIA OppA
YTTNDNSTAYKM

SEQ ID NO: 116 - protein, 12 aa, BORRELIA OppA
TTNDNSTAYKMY

SEQ ID NO: 117 - protein, 12 aa, BORRELIA OppA
SDYYSSAVNAIY

SEQ ID NO: 118 - protein, 12 aa, BORRELIA OppA
DYYSSAVNAIYF

SEQ ID NO: 119 - protein, 12 aa, BORRELIA OppA
YYSSAVNAIYFY

SEQ ID NO: 120 - protein, 12 aa, BORRELIA OppA
YSSAVNAIYFYA

SEQ ID NO: 121 - protein, 12 aa, BORRELIA OppA
LTLAIDRETLTY

SEQ ID NO: 122 - protein, 12 aa, BORRELIA OppA
PLTFLSIFTQGY

SEQ ID NO: 123 - protein, 12 aa, BORRELIA OppA
LTFLSIFTQGYT

SEQ ID NO: 124 - protein, 12 aa, BORRELIA OppA
QFSSHNYSSPEY

SEQ ID NO: 125 - protein, 12 aa, BORRELIA OppA
FSSHNYSSPEYN

SEQ ID NO: 126 - protein, 12 aa, BORRELIA OppA
PLTFLSILTHGY

SEQ ID NO: 127 - protein, 12 aa, BORRELIA OppA
LTFLSILTHGYT

SEQ ID NO: 128 - protein, 12 aa, BORRELIA OppA
PLTFLSIFTHGY

SEQ ID NO: 129 - protein, 12 aa, BORRELIA OppA
LTFLSIFTHGYT

SEQ ID NO: 130 - protein, 12 aa, BORRELIA OppA
TFYTTNDSSTAY

SEQ ID NO: 131 - protein, 12 aa, BORRELIA OppA
FYTTNDSSTAYK

SEQ ID NO: 132 - protein, 12 aa, BORRELIA OppA
YTTNDSSTAYKM

SEQ ID NO: 133 - protein, 12 aa, BORRELIA OppA
TTNDSSTAYKMY

SEQ ID NO: 134 - protein, 12 aa, BORRELIA OppA
NDYYSSAVNAIY

SEQ ID NO: 135 - protein, 12 aa, BORRELIA OppA
PATFLSIFTQGY

SEQ ID NO: 136 - protein, 12 aa, BORRELIA OppA
QFSSHNYSNSEY

SEQ ID NO: 137 - protein, 12 aa, BORRELIA OppA
FSSHNYSNSEYN

SEQ ID NO: 138 - protein, 12 aa, BORRELIA OppA
SSEVEVQEIAFY

SEQ ID NO: 139 - protein, 12 aa, BORRELIA OppA
AFYTTNDSSTAY

SEQ ID NO: 140 - protein, 12 aa, BORRELIA OppA
LTLAIDRETLAY

SEQ ID NO: 141 - protein, 12 aa, BORRELIA OppA
TLAIDRETLAYK

SEQ ID NO: 142 - protein, 12 aa, BORRELIA OppA
QFSSHNYSNPEY

SEQ ID NO: 143 - protein, 12 aa, BORRELIA OppA
FSSHNYSNPEYN

SEQ ID NO: 144 - protein, 12 aa, BORRELIA OppA
QRLVDPKTASPY

SEQ ID NO: 145 - protein, 12 aa, BORRELIA OppA
RLVDPKTASPYA

SEQ ID NO: 146 - protein, 12 aa, BORRELIA OppA
PITSEAADVNRY

SEQ ID NO: 147 - protein, 12 aa, BORRELIA OppA
TQLDVSPQLATY

SEQ ID NO: 148 - protein, 12 aa, BORRELIA OppA
QLDVSPQLATYY

SEQ ID NO: 149 - protein, 12 aa, BORRELIA OppA
NASHPLSFNLLY

SEQ ID NO: 150 - protein, 12 aa, BORRELIA OppA
SENTSQYSNPDY

SEQ ID NO: 151 - protein, 12 aa, BORRELIA OppA
QYSNPDYDQALV

SEQ ID NO: 152 - protein, 12 aa, BORRELIA OppA
GGFTPDKLGYYY

SEQ ID NO: 153 - protein, 12 aa, BORRELIA OppA
GFTPDKLGYYYT

SEQ ID NO: 154 - protein, 12 aa, BORRELIA OppA
FTPDKLGYYYTK

SEQ ID NO: 155 - protein, 9 aa, BORRELIA OppA
KLQKLLFLI

SEQ ID NO: 156 - protein, 9 aa, BORRELIA OppA
KLLFLIIFF

SEQ ID NO: 157 - protein, 9 aa, BORRELIA OppA
LLFLIIFFL

SEQ ID NO: 158 - protein, 9 aa, BORRELIA OppA
FLIIFFLTF

SEQ ID NO: 159 - protein, 9 aa, BORRELIA OppA
LIIFFLTFL

SEQ ID NO: 160 - protein, 9 aa, BORRELIA OppA
SLGAEPSSL

SEQ ID NO: 161 - protein, 9 aa, BORRELIA OppA
KMIDTMFKG

SEQ ID NO: 162 - protein, 9 aa, BORRELIA OppA
IIWSDGVAI

SEQ ID NO: 163 - protein, 9 aa, BORRELIA OppA
AIDEKTLEI

SEQ ID NO: 164 - protein, 9 aa, BORRELIA OppA
AVNAIYFYA

SEQ ID NO: 165 - protein, 9 aa, BORRELIA OppA
AIYFYAFNT

SEQ ID NO: 166 - protein, 9 aa, BORRELIA OppA
YFYAFNTHI

SEQ ID NO: 167 - protein, 9 aa, BORRELIA OppA
VLDDGTTPT

SEQ ID NO: 168 - protein, 9 aa, BORRELIA OppA
YSYAKNLEL

SEQ ID NO: 169 - protein, 9 aa, BORRELIA OppA
NLELFNPEI

SEQ ID NO: 170 - protein, 9 aa, BORRELIA OppA
NQWKKILNI

SEQ ID NO: 171 - protein, 9 aa, BORRELIA OppA
KILNIDVEL

SEQ ID NO: 172 - protein, 9 aa, BORRELIA OppA
WIGDYADPL

SEQ ID NO: 173 - protein, 9 aa, BORRELIA OppA
IIIEKDFPI

SEQ ID NO: 174 - protein, 9 aa, BORRELIA OppA
YIYGNSYLF

SEQ ID NO: 175 - protein, 9 aa, BORRELIA OppA
KLQKLLFSV

SEQ ID NO: 176 - protein, 9 aa, BORRELIA OppA
KLLFSVIFF

SEQ ID NO: 177 - protein, 9 aa, BORRELIA OppA
LLFSVIFFL

SEQ ID NO: 178 - protein, 9 aa, BORRELIA OppA
SVIFFLTFL

SEQ ID NO: 179 - protein, 9 aa, BORRELIA OppA
SLGSEPSSL

SEQ ID NO: 180 - protein, 9 aa, BORRELIA OppA
KMIDTMFRG

SEQ ID NO: 181 - protein, 9 aa, BORRELIA OppA
YFYAFNTYI

SEQ ID NO: 182 - protein, 9 aa, BORRELIA OppA
VLDNGTTPT

SEQ ID NO: 183 - protein, 9 aa, BORRELIA OppA
KLQKSLFLI

SEQ ID NO: 184 - protein, 9 aa, BORRELIA OppA
SLFLIIFFL

SEQ ID NO: 185 - protein, 9 aa, BORRELIA OppA
MVTSGPFKL

SEQ ID NO: 186 - protein, 9 aa, BORRELIA OppA
ELDAIFVSI

SEQ ID NO: 187 - protein, 9 aa, BORRELIA OppA
YFYAFNTTV

SEQ ID NO: 188 - protein, 9 aa, BORRELIA OppA
WIGDYADPA

SEQ ID NO: 189 - protein, 9 aa, BORRELIA OppA
KLQKSLLFL

SEQ ID NO: 190 - protein, 9 aa, BORRELIA OppA
LQKSLLFLI

SEQ ID NO: 191 - protein, 9 aa, BORRELIA OppA
SLLFLIIFF

SEQ ID NO: 192 - protein, 9 aa, BORRELIA OppA
ITWSDGVPI

SEQ ID NO: 193 - protein, 9 aa, BORRELIA OppA
YFYAFNTKV

SEQ ID NO: 194 - protein, 9 aa, BORRELIA OppA
KLQRSLFLI

SEQ ID NO: 195 - protein, 9 aa, BORRELIA OppA
LVHQSFIPV

SEQ ID NO: 196 - protein, 9 aa, BORRELIA OppA
HQSFIPVPV

SEQ ID NO: 197 - protein, 9 aa, BORRELIA OppA
YSYAKSLEL

SEQ ID NO: 198 - protein, 9 aa, BORRELIA OppA
SLELFNPEI

SEQ ID NO: 199 - protein, 9 aa, BORRELIA OppA
SQSRTNFTL

SEQ ID NO: 200 - protein, 9 aa, BORRELIA OppA
TLSLLTAGI

SEQ ID NO: 201 - protein, 9 aa, BORRELIA OppA
LLTAGILCA

SEQ ID NO: 202 - protein, 9 aa, BORRELIA OppA
QLAEKQELV

SEQ ID NO: 203 - protein, 9 aa, BORRELIA OppA
ILSDLFEGL

SEQ ID NO: 204 - protein, 9 aa, BORRELIA OppA
DLFEGLVNV

SEQ ID NO: 205 - protein, 9 aa, BORRELIA OppA
VVWSWQRLV

SEQ ID NO: 206 - protein, 9 aa, BORRELIA OppA
KQAPDTLGV

SEQ ID NO: 207 - protein, 9 aa, BORRELIA OppA
ALNDTTLEV

SEQ ID NO: 208 - protein, 9 aa, BORRELIA OppA
FLAMLAHPS

SEQ ID NO: 209 - protein, 9 aa, BORRELIA OppA
AMLAHPSMV

SEQ ID NO: 210 - protein, 9 aa, BORRELIA OppA
LAHPSMVPV

SEQ ID NO: 211 - protein, 9 aa, BORRELIA OppA
TVINKVTYL

SEQ ID NO: 212 - protein, 9 aa, BORRELIA OppA
YLPITSEAA

SEQ ID NO: 213 - protein, 9 aa, BORRELIA OppA
YTVPINQFA

SEQ ID NO: 214 - protein, 9 aa, BORRELIA OppA
KTMGTQLDV

SEQ ID NO: 215 - protein, 9 aa, BORRELIA OppA
TQLDVSPQL

SEQ ID NO: 216 - protein, 9 aa, BORRELIA OppA
LLEEAGFNA

SEQ ID NO: 217 - protein, 9 aa, BORRELIA OppA
SMWKKNLGV

SEQ ID NO: 218 - protein, 9 aa, BORRELIA OppA
TMHTHNFDA

SEQ ID NO: 219 - protein, 9 aa, BORRELIA OppA
WIADYDDAA

SEQ ID NO: 220 - protein, 9 aa, BORRELIA OppA
LLGRDVPAI

SEQ ID NO: 221 - protein, 10 aa, BORRELIA OppA
MKLQKLLFLI

SEQ ID NO: 222 - protein, 10 aa, BORRELIA OppA
KLQKLLFLII

SEQ ID NO: 223 - protein, 10 aa, BORRELIA OppA
KLLFLIIFFL

SEQ ID NO: 224 - protein, 10 aa, BORRELIA OppA
LLFLIIFFLT

SEQ ID NO: 225 - protein, 10 aa, BORRELIA OppA
LFLIIFFLTF

SEQ ID NO: 226 - protein, 10 aa, BORRELIA OppA
FLIIFFLTFL

SEQ ID NO: 227 - protein, 10 aa, BORRELIA OppA
LIIFFLTFLC

SEQ ID NO: 228 - protein, 10 aa, BORRELIA OppA
KMIDTMFKGL

SEQ ID NO: 229 - protein, 10 aa, BORRELIA OppA
TLESPKPYFI

SEQ ID NO: 230 - protein, 10 aa, BORRELIA OppA
IDMLVHQSFI

SEQ ID NO: 231 - protein, 10 aa, BORRELIA OppA
MLVHQSFIPI

SEQ ID NO: 232 - protein, 10 aa, BORRELIA OppA
KMYENGELDA

SEQ ID NO: 233 - protein, 10 aa, BORRELIA OppA
GELDAIFSAI

SEQ ID NO: 234 - protein, 10 aa, BORRELIA OppA
AIFSAIPPDL

SEQ ID NO: 235 - protein, 10 aa, BORRELIA OppA
KLRSDYYSSA

SEQ ID NO: 236 - protein, 10 aa, BORRELIA OppA
YAFNTHIKPL

SEQ ID NO: 237 - protein, 10 aa, BORRELIA OppA
KVLDDGTTPT

SEQ ID NO: 238 - protein, 10 aa, BORRELIA OppA
KNLELFNPEI

SEQ ID NO: 239 - protein, 10 aa, BORRELIA OppA
KKILNIDVEL

SEQ ID NO: 240 - protein, 10 aa, BORRELIA OppA
YADPLTFLSI

SEQ ID NO: 241 - protein, 10 aa, BORRELIA OppA
FLSIFTQGYT

SEQ ID NO: 242 - protein, 10 aa, BORRELIA OppA
EIIIEKDFPI

SEQ ID NO: 243 - protein, 10 aa, BORRELIA OppA
IIIEKDFPIA

SEQ ID NO: 244 - protein, 10 aa, BORRELIA OppA
FLSILTHGYT

SEQ ID NO: 245 - protein, 10 aa, BORRELIA OppA
FLSIFTHGYT

SEQ ID NO: 246 - protein, 10 aa, BORRELIA OppA
MKLQKLLFSV

SEQ ID NO: 247 - protein, 10 aa, BORRELIA OppA
KLQKLLFSVI

SEQ ID NO: 248 - protein, 10 aa, BORRELIA OppA
KLLFSVIFFL

SEQ ID NO: 249 - protein, 10 aa, BORRELIA OppA
LLFSVIFFLT

SEQ ID NO: 250 - protein, 10 aa, BORRELIA OppA
FSVIFFLTFL

SEQ ID NO: 251 - protein, 10 aa, BORRELIA OppA
KMIDTMFRGL

SEQ ID NO: 252 - protein, 10 aa, BORRELIA OppA
KMYENKELDA

SEQ ID NO: 253 - protein, 10 aa, BORRELIA OppA
KELDAIFGSI

SEQ ID NO: 254 - protein, 10 aa, BORRELIA OppA
AIFGSIPPDL

SEQ ID NO: 255 - protein, 10 aa, BORRELIA OppA
YAFNTYIKPL

SEQ ID NO: 256 - protein, 10 aa, BORRELIA OppA
MKLQKSLFLI

SEQ ID NO: 257 - protein, 10 aa, BORRELIA OppA
KLQKSLFLII

SEQ ID NO: 258 - protein, 10 aa, BORRELIA OppA
KSLFLIIFFL

SEQ ID NO: 259 - protein, 10 aa, BORRELIA OppA
SLFLIIFFLT

SEQ ID NO: 260 - protein, 10 aa, BORRELIA OppA
KELDAIFVSI

SEQ ID NO: 261 - protein, 10 aa, BORRELIA OppA
AIFVSIPPDL

SEQ ID NO: 262 - protein, 10 aa, BORRELIA OppA
KLRNDYYSSA

SEQ ID NO: 263 - protein, 10 aa, BORRELIA OppA
IYFYAFNTTV

SEQ ID NO: 264 - protein, 10 aa, BORRELIA OppA
YAFNTTVKPL

SEQ ID NO: 265 - protein, 10 aa, BORRELIA OppA
MKLQKSLLFL

SEQ ID NO: 266 - protein, 10 aa, BORRELIA OppA
KLQKSLLFLI

SEQ ID NO: 267 - protein, 10 aa, BORRELIA OppA
KSLLFLIIFF

SEQ ID NO: 268 - protein, 10 aa, BORRELIA OppA
SLLFLIIFFL

SEQ ID NO: 269 - protein, 10 aa, BORRELIA OppA
KITWSDGVPI

SEQ ID NO: 270 - protein, 10 aa, BORRELIA OppA
KMYENEELDA

SEQ ID NO: 271 - protein, 10 aa, BORRELIA OppA
MKLQRSLFLI

SEQ ID NO: 272 - protein, 10 aa, BORRELIA OppA
KLQRSLFLII

SEQ ID NO: 273 - protein, 10 aa, BORRELIA OppA
RSLFLIIFFL

SEQ ID NO: 274 - protein, 10 aa, BORRELIA OppA
KMIDTMFRGI

SEQ ID NO: 275 - protein, 10 aa, BORRELIA OppA
MLVHQSFIPV

SEQ ID NO: 276 - protein, 10 aa, BORRELIA OppA
VELEEITFYT

SEQ ID NO: 277 - protein, 10 aa, BORRELIA OppA
KSLELFNPEI

SEQ ID NO: 278 - protein, 10 aa, BORRELIA OppA
FTLSLLTAGI

SEQ ID NO: 279 - protein, 10 aa, BORRELIA OppA
TLSLLTAGIL

SEQ ID NO: 280 - protein, 10 aa, BORRELIA OppA
SLLTAGILCA

SEQ ID NO: 281 - protein, 10 aa, BORRELIA OppA
TQLAEKQELV

SEQ ID NO: 282 - protein, 10 aa, BORRELIA OppA
NILSDLFEGL

SEQ ID NO: 283 - protein, 10 aa, BORRELIA OppA
ILSDLFEGLV

SEQ ID NO: 284 - protein, 10 aa, BORRELIA OppA
SDLFEGLVNV

SEQ ID NO: 285 - protein, 10 aa, BORRELIA OppA
KALNDTTLEV

SEQ ID NO: 286 - protein, 10 aa, BORRELIA OppA
ALNDTTLEVT

SEQ ID NO: 287 - protein, 10 aa, BORRELIA OppA
FLAMLAHPSM

SEQ ID NO: 288 - protein, 10 aa, BORRELIA OppA
LAMLAHPSMV

SEQ ID NO: 289 - protein, 10 aa, BORRELIA OppA
AMLAHPSMVP

SEQ ID NO: 290 - protein, 10 aa, BORRELIA OppA
MLAHPSMVPV

SEQ ID NO: 291 - protein, 10 aa, BORRELIA OppA
SMVPVDKVLI

SEQ ID NO: 292 - protein, 10 aa, BORRELIA OppA
KLLEEAGFNA

SEQ ID NO: 293 - protein, 10 aa, BORRELIA OppA
SSMWKKNLGV

SEQ ID NO: 294 - protein, 10 aa, BORRELIA OppA
SMWKKNLGVE

SEQ ID NO: 295 - protein, 10 aa, BORRELIA OppA
TMHTHNFDAV

SEQ ID NO: 296 - protein, 11 aa, BORRELIA OppA
QKLLFLIIFFL

SEQ ID NO: 297 - protein, 11 aa, BORRELIA OppA
KLLFLIIFFLT

SEQ ID NO: 298 - protein, 11 aa, BORRELIA OppA
LLFLIIFFLTF

SEQ ID NO: 299 - protein, 11 aa, BORRELIA OppA
LFLIIFFLTFL

SEQ ID NO: 300 - protein, 11 aa, BORRELIA OppA
FLIIFFLTFLC

SEQ ID NO: 301 - protein, 11 aa, BORRELIA OppA
SLDPQLADDNV

SEQ ID NO: 302 - protein, 11 aa, BORRELIA OppA
SKMIDTMFKGL

SEQ ID NO: 303 - protein, 11 aa, BORRELIA OppA
KMIDTMFKGLI

SEQ ID NO: 304 - protein, 11 aa, BORRELIA OppA
FIDMLVHQSFI

SEQ ID NO: 305 - protein, 11 aa, BORRELIA OppA
DMLVHQSFIPI

SEQ ID NO: 306 - protein, 11 aa, BORRELIA OppA
KMYENGELDAI

SEQ ID NO: 307 - protein, 11 aa, BORRELIA OppA
KLRSDYYSSAV

SEQ ID NO: 308 - protein, 11 aa, BORRELIA OppA
MKLQKLLFSVI

SEQ ID NO: 309 - protein, 11 aa, BORRELIA OppA
QKLLFSVIFFL

SEQ ID NO: 310 - protein, 11 aa, BORRELIA OppA
KLLFSVIFFLT

SEQ ID NO: 311 - protein, 11 aa, BORRELIA OppA
LLFSVIFFLTF

SEQ ID NO: 312 - protein, 11 aa, BORRELIA OppA
LFSVIFFLTFL

SEQ ID NO: 313 - protein, 11 aa, BORRELIA OppA
SKMIDTMFRGL

SEQ ID NO: 314 - protein, 11 aa, BORRELIA OppA
KMIDTMFRGLI

SEQ ID NO: 315 - protein, 11 aa, BORRELIA OppA
KMYENKELDAI

SEQ ID NO: 316 - protein, 11 aa, BORRELIA OppA
AIYFYAFNTYI

SEQ ID NO: 317 - protein, 11 aa, BORRELIA OppA
QKSLFLIIFFL

SEQ ID NO: 318 - protein, 11 aa, BORRELIA OppA
KSLFLIIFFLT

SEQ ID NO: 319 - protein, 11 aa, BORRELIA OppA
SLFLIIFFLTF

SEQ ID NO: 320 - protein, 11 aa, BORRELIA OppA
SLDPQLAEDNV

SEQ ID NO: 321 - protein, 11 aa, BORRELIA OppA
KLRNDYYSSAV

SEQ ID NO: 322 - protein, 11 aa, BORRELIA OppA
AIYFYAFNTTV

SEQ ID NO: 323 - protein, 11 aa, BORRELIA OppA
MKLQKSLLFLI

SEQ ID NO: 324 - protein, 11 aa, BORRELIA OppA
KSLLFLIIFFL

SEQ ID NO: 325 - protein, 11 aa, BORRELIA OppA
SLLFLIIFFLT

SEQ ID NO: 326 - protein, 11 aa, BORRELIA OppA
KMYENEELDAI

SEQ ID NO: 327 - protein, 11 aa, BORRELIA OppA
AIYFYAFNTKV

SEQ ID NO: 328 - protein, 11 aa, BORRELIA OppA
QRSLFLIIFFL

SEQ ID NO: 329 - protein, 11 aa, BORRELIA OppA
RSLFLIIFFLT

SEQ ID NO: 330 - protein, 11 aa, BORRELIA OppA
SKMIDTMFRGI

SEQ ID NO: 331 - protein, 11 aa, BORRELIA OppA
KMIDTMFRGIV

SEQ ID NO: 332 - protein, 11 aa, BORRELIA OppA
DMLVHQSFIPV

SEQ ID NO: 333 - protein, 11 aa, BORRELIA OppA
MLVHQSFIPVP

SEQ ID NO: 334 - protein, 11 aa, BORRELIA OppA
NFTLSLLTAGI

SEQ ID NO: 335 - protein, 11 aa, BORRELIA OppA
FNILSDLFEGL

SEQ ID NO: 336 - protein, 11 aa, BORRELIA OppA
NILSDLFEGLV

SEQ ID NO: 337 - protein, 11 aa, BORRELIA OppA
LSDLFEGLVNV

SEQ ID NO: 338 - protein, 11 aa, BORRELIA OppA
SDLFEGLVNVS

SEQ ID NO: 339 - protein, 11 aa, BORRELIA OppA
VKALNDTTLEV

SEQ ID NO: 340 - protein, 11 aa, BORRELIA OppA
AFLAMLAHPSM

SEQ ID NO: 341 - protein, 11 aa, BORRELIA OppA
FLAMLAHPSMV

SEQ ID NO: 342 - protein, 11 aa, BORRELIA OppA
AMLAHPSMVPV

SEQ ID NO: 343 - protein, 11 aa, BORRELIA OppA
MLAHPSMVPVD

SEQ ID NO: 344 - protein, 11 aa, BORRELIA OppA
ALDKDIIADKV

SEQ ID NO: 345 - protein, 11 aa, BORRELIA OppA
ASSMWKKNLGV

SEQ ID NO: 346 - protein, 12 aa, BORRELIA OppA
LQKLLFLIIFFL

SEQ ID NO: 347 - protein, 12 aa, BORRELIA OppA
QKLLFLIIFFLT

SEQ ID NO: 348 - protein, 12 aa, BORRELIA OppA
KLLFLIIFFLTF

SEQ ID NO: 349 - protein, 12 aa, BORRELIA OppA
LLFLIIFFLTFL

SEQ ID NO: 350 - protein, 12 aa, BORRELIA OppA
LFLIIFFLTFLC

SEQ ID NO: 351 - protein, 12 aa, BORRELIA OppA
FLIIFFLTFLCC

SEQ ID NO: 352 - protein, 12 aa, BORRELIA OppA
GSKMIDTMFKGL

SEQ ID NO: 353 - protein, 12 aa, BORRELIA OppA
SKMIDTMFKGLI

SEQ ID NO: 354 - protein, 12 aa, BORRELIA OppA
KMIDTMFKGLIT

SEQ ID NO: 355 - protein, 12 aa, BORRELIA OppA
IDMLVHQSFIPI

SEQ ID NO: 356 - protein, 12 aa, BORRELIA OppA
MLVHQSFIPIPI

SEQ ID NO: 357 - protein, 12 aa, BORRELIA OppA
KLKERIPNEKYV

SEQ ID NO: 358 - protein, 12 aa, BORRELIA OppA
FIQNQWKKILNI

SEQ ID NO: 359 - protein, 12 aa, BORRELIA OppA
YLNTKSNGNYEI

SEQ ID NO: 360 - protein, 12 aa, BORRELIA OppA
MKLQKLLFSVIF

SEQ ID NO: 361 - protein, 12 aa, BORRELIA OppA
LQKLLFSVIFFL

SEQ ID NO: 362 - protein, 12 aa, BORRELIA OppA
QKLLFSVIFFLT

SEQ ID NO: 363 - protein, 12 aa, BORRELIA OppA
KLLFSVIFFLTF

SEQ ID NO: 364 - protein, 12 aa, BORRELIA OppA
LLFSVIFFLTFL

SEQ ID NO: 365 - protein, 12 aa, BORRELIA OppA
GSKMIDTMFRGL

SEQ ID NO: 366 - protein, 12 aa, BORRELIA OppA
SKMIDTMFRGLI

SEQ ID NO: 367 - protein, 12 aa, BORRELIA OppA
KMIDTMFRGLIT

SEQ ID NO: 368 - protein, 12 aa, BORRELIA OppA
YLNTRSNGNYEI

SEQ ID NO: 369 - protein, 12 aa, BORRELIA OppA
LQKSLFLIIFFL

SEQ ID NO: 370 - protein, 12 aa, BORRELIA OppA
QKSLFLIIFFLT

SEQ ID NO: 371 - protein, 12 aa, BORRELIA OppA
KSLFLIIFFLTF

SEQ ID NO: 372 - protein, 12 aa, BORRELIA OppA
SLFLIIFFLTFL

SEQ ID NO: 373 - protein, 12 aa, BORRELIA OppA
SSLDPQLAEDNV

SEQ ID NO: 374 - protein, 12 aa, BORRELIA OppA
ASKMIDTMFRGL

SEQ ID NO: 375 - protein, 12 aa, BORRELIA OppA
NAIYFYAFNTTV

SEQ ID NO: 376 - protein, 12 aa, BORRELIA OppA
QKSLLFLIIFFL

SEQ ID NO: 377 - protein, 12 aa, BORRELIA OppA
KSLLFLIIFFLT

SEQ ID NO: 378 - protein, 12 aa, BORRELIA OppA
SLLFLIIFFLTF

SEQ ID NO: 379 - protein, 12 aa, BORRELIA OppA
YLNTKANGNYEI

SEQ ID NO: 380 - protein, 12 aa, BORRELIA OppA
LQRSLFLIIFFL

SEQ ID NO: 381 - protein, 12 aa, BORRELIA OppA
QRSLFLIIFFLT

SEQ ID NO: 382 - protein, 12 aa, BORRELIA OppA
RSLFLIIFFLTF

SEQ ID NO: 383 - protein, 12 aa, BORRELIA OppA
ASKMIDTMFRGI

SEQ ID NO: 384 - protein, 12 aa, BORRELIA OppA
SKMIDTMFRGIV

SEQ ID NO: 385 - protein, 12 aa, BORRELIA OppA
KMIDTMFRGIVT

SEQ ID NO: 386 - protein, 12 aa, BORRELIA OppA
IDMLVHQSFIPV

SEQ ID NO: 387 - protein, 12 aa, BORRELIA OppA
DMLVHQSFIPVP

SEQ ID NO: 388 - protein, 12 aa, BORRELIA OppA
MLVHQSFIPVPV

SEQ ID NO: 389 - protein, 12 aa, BORRELIA OppA
TNFTLSLLTAGI

SEQ ID NO: 390 - protein, 12 aa, BORRELIA OppA
EFNILSDLFEGL

SEQ ID NO: 391 - protein, 12 aa, BORRELIA OppA
FNILSDLFEGLV

SEQ ID NO: 392 - protein, 12 aa, BORRELIA OppA
ILSDLFEGLVNV

SEQ ID NO: 393 - protein, 12 aa, BORRELIA OppA
LSDLFEGLVNVS

SEQ ID NO: 394 - protein, 12 aa, BORRELIA OppA
SDLFEGLVNVSP

SEQ ID NO: 395 - protein, 12 aa, BORRELIA OppA
GVKALNDTTLEV

SEQ ID NO: 396 - protein, 12 aa, BORRELIA OppA
AAFLAMLAHPSM

SEQ ID NO: 397 - protein, 12 aa, BORRELIA OppA
AFLAMLAHPSMV

SEQ ID NO: 398 - protein, 12 aa, BORRELIA OppA
FLAMLAHPSMVP

SEQ ID NO: 399 - protein, 12 aa, BORRELIA OppA
LAMLAHPSMVPV

SEQ ID NO: 400 - protein, 12 aa, BORRELIA OppA
AMLAHPSMVPVD

SEQ ID NO: 401 - protein, 12 aa, BORRELIA OppA
MLAHPSMVPVDK

SEQ ID NO: 402 - protein, 12 aa, BORRELIA OppA
KLSQWVVNERIV

SEQ ID NO: 403 - protein, 12 aa, BORRELIA OppA
AASSMWKKNLGV

SEQ ID NO: 404 - protein, 12 aa, BORRELIA OppA
KLGYYYTKDMYI

SEQ ID NO: 405 - protein, 12 aa, BORRELIA OppA
VLDDGTTPTRRI

SEQ ID NO: 406 - protein, 9 aa, BORRELIA OppA
FLTFLCCNK

SEQ ID NO: 407 - protein, 9 aa, BORRELIA OppA
GGNKPGLAK

SEQ ID NO: 408 - protein, 9 aa, BORRELIA OppA
AITAEGIRK

SEQ ID NO: 409 - protein, 9 aa, BORRELIA OppA
KSYLRILNK

SEQ ID NO: 410 - protein, 9 aa, BORRELIA OppA
GSNYSEMVK

SEQ ID NO: 411 - protein, 9 aa, BORRELIA OppA
KSTIKNGQK

SEQ ID NO: 412 - protein, 9 aa, BORRELIA OppA
NIVTSGPFK

SEQ ID NO: 413 - protein, 9 aa, BORRELIA OppA
VTSGPFKLK

SEQ ID NO: 414 - protein, 9 aa, BORRELIA OppA
RITPNFSSY

SEQ ID NO: 415 - protein, 9 aa, BORRELIA OppA
ELFNPEIAK

SEQ ID NO: 416 - protein, 9 aa, BORRELIA OppA
GSNYAEMVK

SEQ ID NO: 417 - protein, 9 aa, BORRELIA OppA
TAYKMYENK

SEQ ID NO: 418 - protein, 9 aa, BORRELIA OppA
RIAPNFSSY

SEQ ID NO: 419 - protein, 9 aa, BORRELIA OppA
FLTFLCCSK

SEQ ID NO: 420 - protein, 9 aa, BORRELIA OppA
KAKEGVSFK

SEQ ID NO: 421 - protein, 9 aa, BORRELIA OppA
GGNRPGLAK

SEQ ID NO: 422 - protein, 9 aa, BORRELIA OppA
ILNKETGSK

SEQ ID NO: 423 - protein, 9 aa, BORRELIA OppA
GSKYVEMVK

SEQ ID NO: 424 - protein, 9 aa, BORRELIA OppA
KSAIKNGQK

SEQ ID NO: 425 - protein, 9 aa, BORRELIA OppA
NMVTSGPFK

SEQ ID NO: 426 - protein, 9 aa, BORRELIA OppA
VSIPPDLIK

SEQ ID NO: 427 - protein, 9 aa, BORRELIA OppA
SEYNELIKK

SEQ ID NO: 428 - protein, 9 aa, BORRELIA OppA
KVRPLDNVK

SEQ ID NO: 429 - protein, 9 aa, BORRELIA OppA
LTFLCCNNK

SEQ ID NO: 430 - protein, 9 aa, BORRELIA OppA
KSVIKNGQK

SEQ ID NO: 431 - protein, 9 aa, BORRELIA OppA
RLAEKWENK

SEQ ID NO: 432 - protein, 9 aa, BORRELIA OppA
KTASPYASY

SEQ ID NO: 433 - protein, 9 aa, BORRELIA OppA
VLINRFGEK

SEQ ID NO: 434 - protein, 9 aa, BORRELIA OppA
HLVTSGAYK

SEQ ID NO: 435 - protein, 9 aa, BORRELIA OppA
KALNMALDK

SEQ ID NO: 436 - protein, 9 aa, BORRELIA OppA
LLYNTSESH

SEQ ID NO: 437 - protein, 9 aa, BORRELIA OppA
AIAASSMWK

SEQ ID NO: 438 - protein, 9 aa, BORRELIA OppA
IAASSMWKK

SEQ ID NO: 439 - protein, 9 aa, BORRELIA OppA
ALVNAAKAK

SEQ ID NO: 440 - protein, 9 aa, BORRELIA OppA
YTKDMYIKK

SEQ ID NO: 441 - protein, 10 aa, BORRELIA OppA
FFLTFLCCNK

SEQ ID NO: 442 - protein, 10 aa, BORRELIA OppA
QLADDNVGSK

SEQ ID NO: 443 - protein, 10 aa, BORRELIA OppA
GSKMIDTMFK

SEQ ID NO: 444 - protein, 10 aa, BORRELIA OppA
TVYTFTLREK

SEQ ID NO: 445 - protein, 10 aa, BORRELIA OppA
VAITAEGIRK

SEQ ID NO: 446 - protein, 10 aa, BORRELIA OppA
RKSYLRILNK

SEQ ID NO: 447 - protein, 10 aa, BORRELIA OppA
KSYLRILNKE

SEQ ID NO: 448 - protein, 10 aa, BORRELIA OppA
ILNKETGSNY

SEQ ID NO: 449 - protein, 10 aa, BORRELIA OppA
TGSNYSEMVK

SEQ ID NO: 450 - protein, 10 aa, BORRELIA OppA
YSEMVKSTIK

SEQ ID NO: 451 - protein, 10 aa, BORRELIA OppA
TLEITLESPK

SEQ ID NO: 452 - protein, 9 aa, BORRELIA OppA
FLTFLCCNK

SEQ ID NO: 453 - protein, 9 aa, BORRELIA OppA
GGNKPGLAK

SEQ ID NO: 454 - protein, 9 aa, BORRELIA OppA
AITAEGIRK

SEQ ID NO: 455 - protein, 9 aa, BORRELIA OppA
KSYLRILNK

SEQ ID NO: 456 - protein, 9 aa, BORRELIA OppA
GSNYSEMVK

SEQ ID NO: 457 - protein, 9 aa, BORRELIA OppA
KSTIKNGQK

SEQ ID NO: 458 - protein, 9 aa, BORRELIA OppA
NIVTSGPFK

SEQ ID NO: 459 - protein, 9 aa, BORRELIA OppA
VTSGPFKLK

SEQ ID NO: 460 - protein, 9 aa, BORRELIA OppA
RITPNFSSY

SEQ ID NO: 461 - protein, 9 aa, BORRELIA OppA
ELFNPEIAK

SEQ ID NO: 462 - protein, 9 aa, BORRELIA OppA
GSNYAEMVK

SEQ ID NO: 463 - protein, 9 aa, BORRELIA OppA
TAYKMYENK

SEQ ID NO: 464 - protein, 9 aa, BORRELIA OppA
RIAPNFSSY

SEQ ID NO: 465 - protein, 9 aa, BORRELIA OppA
FLTFLCCSK

SEQ ID NO: 466 - protein, 9 aa, BORRELIA OppA
KAKEGVSFK

SEQ ID NO: 467 - protein, 9 aa, BORRELIA OppA
GGNRPGLAK

SEQ ID NO: 468 - protein, 9 aa, BORRELIA OppA
ILNKETGSK

SEQ ID NO: 469 - protein, 9 aa, BORRELIA OppA
GSKYVEMVK

SEQ ID NO: 470 - protein, 9 aa, BORRELIA OppA
KSAIKNGQK

SEQ ID NO: 471 - protein, 9 aa, BORRELIA OppA
NMVTSGPFK

SEQ ID NO: 472 - protein, 9 aa, BORRELIA OppA
VSIPPDLIK

SEQ ID NO: 473 - protein, 9 aa, BORRELIA OppA
SEYNELIKK

SEQ ID NO: 474 - protein, 9 aa, BORRELIA OppA
KVRPLDNVK

SEQ ID NO: 475 - protein, 9 aa, BORRELIA OppA
LTFLCCNNK

SEQ ID NO: 476 - protein, 9 aa, BORRELIA OppA
KSVIKNGQK

SEQ ID NO: 477 - protein, 9 aa, BORRELIA OppA
RLAEKWENK

SEQ ID NO: 478 - protein, 9 aa, BORRELIA OppA
KTASPYASY

SEQ ID NO: 479 - protein, 9 aa, BORRELIA OppA
VLINRFGEK

SEQ ID NO: 480 - protein, 9 aa, BORRELIA OppA
HLVTSGAYK

SEQ ID NO: 481 - protein, 9 aa, BORRELIA OppA
KALNMALDK

SEQ ID NO: 482 - protein, 9 aa, BORRELIA OppA
LLYNTSESH

SEQ ID NO: 483 - protein, 9 aa, BORRELIA OppA
AIAASSMWK

SEQ ID NO: 484 - protein, 9 aa, BORRELIA OppA
IAASSMWKK

SEQ ID NO: 485 - protein, 9 aa, BORRELIA OppA
ALVNAAKAK

SEQ ID NO: 486 - protein, 9 aa, BORRELIA OppA
YTKDMYIKK

SEQ ID NO: 487 - protein, 10 aa, BORRELIA OppA
FFLTFLCCNK

SEQ ID NO: 488 - protein, 10 aa, BORRELIA OppA
QLADDNVGSK

SEQ ID NO: 489 - protein, 10 aa, BORRELIA OppA
GSKMIDTMFK

SEQ ID NO: 490 - protein, 10 aa, BORRELIA OppA
TVYTFTLREK

SEQ ID NO: 491 - protein, 10 aa, BORRELIA OppA
VAITAEGIRK

SEQ ID NO: 492 - protein, 10 aa, BORRELIA OppA
RKSYLRILNK

SEQ ID NO: 493 - protein, 10 aa, BORRELIA OppA
KSYLRILNKE

SEQ ID NO: 494 - protein, 10 aa, BORRELIA OppA
ILNKETGSNY

SEQ ID NO: 495 - protein, 10 aa, BORRELIA OppA
TGSNYSEMVK

SEQ ID NO: 496 - protein, 10 aa, BORRELIA OppA
YSEMVKSTIK

SEQ ID NO: 497 - protein, 10 aa, BORRELIA OppA
TLEITLESPK

SEQ ID NO: 498 - protein, 10 aa, BORRELIA OppA
IVTSGPFKLK

SEQ ID NO: 499 - protein, 10 aa, BORRELIA OppA
VTSGPFKLKE

SEQ ID NO: 500 - protein, 10 aa, BORRELIA OppA
KLKERIPNEK

SEQ ID NO: 501 - protein, 10 aa, BORRELIA OppA
TTNDNSTAYK

SEQ ID NO: 502 - protein, 10 aa, BORRELIA OppA
FSAIPPDLIK

SEQ ID NO: 503 - protein, 10 aa, BORRELIA OppA
AIYFYAFNTH

SEQ ID NO: 504 - protein, 10 aa, BORRELIA OppA
YFYAFNTHIK

SEQ ID NO: 505 - protein, 10 aa, BORRELIA OppA
KPLDNVKVRK

SEQ ID NO: 506 - protein, 10 aa, BORRELIA OppA
AIDRETLTYK

SEQ ID NO: 507 - protein, 10 aa, BORRELIA OppA
RRITPNFSSY

SEQ ID NO: 508 - protein, 10 aa, BORRELIA OppA
LELFNPEIAK

SEQ ID NO: 509 - protein, 10 aa, BORRELIA OppA
KLKYNTSEAH

SEQ ID NO: 510 - protein, 10 aa, BORRELIA OppA
APIYIYGNSY

SEQ ID NO: 511 - protein, 10 aa, BORRELIA OppA
YIYGNSYLFR

SEQ ID NO: 512 - protein, 10 aa, BORRELIA OppA
GNSYLFRNDK

SEQ ID NO: 513 - protein, 10 aa, BORRELIA OppA
RFDLSQLKLK

SEQ ID NO: 514 - protein, 10 aa, BORRELIA OppA
FDLSQLKLKK

SEQ ID NO: 515 - protein, 10 aa, BORRELIA OppA
TGSNYAEMVK

SEQ ID NO: 516 - protein, 10 aa, BORRELIA OppA
TTNDSSTAYK

SEQ ID NO: 517 - protein, 10 aa, BORRELIA OppA
STAYKMYENK

SEQ ID NO: 518 - protein, 10 aa, BORRELIA OppA
AIYFYAFNTY

SEQ ID NO: 519 - protein, 10 aa, BORRELIA OppA
YFYAFNTYIK

SEQ ID NO: 520 - protein, 10 aa, BORRELIA OppA
RRIAPNFSSY

SEQ ID NO: 521 - protein, 10 aa, BORRELIA OppA
FFLTFLCCSK

SEQ ID NO: 522 - protein, 10 aa, BORRELIA OppA
LTFLCCSKEK

SEQ ID NO: 523 - protein, 10 aa, BORRELIA OppA
EKAKEGVSFK

SEQ ID NO: 524 - protein, 10 aa, BORRELIA OppA
QLAEDNVASK

SEQ ID NO: 525 - protein, 10 aa, BORRELIA OppA
ASKMIDTMFR

SEQ ID NO: 526 - protein, 10 aa, BORRELIA OppA
RILNKETGSK

SEQ ID NO: 527 - protein, 10 aa, BORRELIA OppA
ILNKETGSKY

SEQ ID NO: 528 - protein, 10 aa, BORRELIA OppA
YVEMVKSAIK

SEQ ID NO: 529 - protein, 10 aa, BORRELIA OppA
ENMVTSGPFK

SEQ ID NO: 530 - protein, 10 aa, BORRELIA OppA
MVTSGPFKLK

SEQ ID NO: 531 - protein, 10 aa, BORRELIA OppA
FVSIPPDLIK

SEQ ID NO: 532 - protein, 10 aa, BORRELIA OppA
YFYAFNTTVK

SEQ ID NO: 533 - protein, 10 aa, BORRELIA OppA
TTVKPLDNVK

SEQ ID NO: 534 - protein, 10 aa, BORRELIA OppA
ATPNFSSYSY

SEQ ID NO: 535 - protein, 10 aa, BORRELIA OppA
NSEYNELIKK

SEQ ID NO: 536 - protein, 10 aa, BORRELIA OppA
RQAEEIIIEK

SEQ ID NO: 537 - protein, 10 aa, BORRELIA OppA
VPITAEGIRK

SEQ ID NO: 538 - protein, 10 aa, BORRELIA OppA
AIYFYAFNTK

SEQ ID NO: 539 - protein, 10 aa, BORRELIA OppA
RPLDNVKVRK

SEQ ID NO: 540 - protein, 10 aa, BORRELIA OppA
AIDRETLAYK

SEQ ID NO: 541 - protein, 10 aa, BORRELIA OppA
FLTFLCCNNK

SEQ ID NO: 542 - protein, 10 aa, BORRELIA OppA
KERKEGVSFK

SEQ ID NO: 543 - protein, 10 aa, BORRELIA OppA
TVYTFNLREK

SEQ ID NO: 544 - protein, 10 aa, BORRELIA OppA
YVEMVKSVIK

SEQ ID NO: 545 - protein, 10 aa, BORRELIA OppA
KPLDNVKIRK

SEQ ID NO: 546 - protein, 10 aa, BORRELIA OppA
GEIQPRLAEK

SEQ ID NO: 547 - protein, 10 aa, BORRELIA OppA
PRLAEKWENK

SEQ ID NO: 548 - protein, 10 aa, BORRELIA OppA
KQAPDTLGVK

SEQ ID NO: 549 - protein, 10 aa, BORRELIA OppA
KVLINRFGEK

SEQ ID NO: 550 - protein, 10 aa, BORRELIA OppA
VLINRFGEKW

SEQ ID NO: 551 - protein, 10 aa, BORRELIA OppA
EHLVTSGAYK

SEQ ID NO: 552 - protein, 10 aa, BORRELIA OppA
HLVTSGAYKL

SEQ ID NO: 553 - protein, 10 aa, BORRELIA OppA
KLSQWVVNER

SEQ ID NO: 554 - protein, 10 aa, BORRELIA OppA
VPINQFAQLK

SEQ ID NO: 555 - protein, 10 aa, BORRELIA OppA
RKALNMALDK

SEQ ID NO: 556 - protein, 10 aa, BORRELIA OppA
ALDKDIIADK

SEQ ID NO: 557 - protein, 10 aa, BORRELIA OppA
IAIAASSMWK

SEQ ID NO: 558 - protein, 10 aa, BORRELIA OppA
AIAASSMWKK

SEQ ID NO: 559 - protein, 10 aa, BORRELIA OppA
HTHNFDAVRY

SEQ ID NO: 560 - protein, 10 aa, BORRELIA OppA
AVRYAWIADY

SEQ ID NO: 561 - protein, 11 aa, BORRELIA OppA
GTVYTFTLREK

SEQ ID NO: 562 - protein, 11 aa, BORRELIA OppA
TVYTFTLREKI

SEQ ID NO: 563 - protein, 11 aa, BORRELIA OppA
IRKSYLRILNK

SEQ ID NO: 564 - protein, 11 aa, BORRELIA OppA
RKSYLRILNKE

SEQ ID NO: 565 - protein, 11 aa, BORRELIA OppA
KSYLRILNKET

SEQ ID NO: 566 - protein, 11 aa, BORRELIA OppA
KTLEITLESPK

SEQ ID NO: 567 - protein, 11 aa, BORRELIA OppA
LAIDRETLTYK

SEQ ID NO: 568 - protein, 11 aa, BORRELIA OppA
NLELFNPEIAK

SEQ ID NO: 569 - protein, 11 aa, BORRELIA OppA
KLKYNTSEAHK

SEQ ID NO: 570 - protein, 11 aa, BORRELIA OppA
RFDLSQLKLKK

SEQ ID NO: 571 - protein, 11 aa, BORRELIA OppA
LRILNKETGSK

SEQ ID NO: 572 - protein, 11 aa, BORRELIA OppA
NMVTSGPFKLK

SEQ ID NO: 573 - protein, 11 aa, BORRELIA OppA
KLKYNTSDANK

SEQ ID NO: 574 - protein, 11 aa, BORRELIA OppA
KTGGNRPGLAK

SEQ ID NO: 575 - protein, 11 aa, BORRELIA OppA
NAIYFYAFNTK

SEQ ID NO: 576 - protein, 11 aa, BORRELIA OppA
AIYFYAFNTKV

SEQ ID NO: 577 - protein, 11 aa, BORRELIA OppA
GTVYTFNLREK

SEQ ID NO: 578 - protein, 11 aa, BORRELIA OppA
TVYTFNLREKI

SEQ ID NO: 579 - protein, 11 aa, BORRELIA OppA
SLELFNPEIAK

SEQ ID NO: 580 - protein, 11 aa, BORRELIA OppA
KLKYNTNEANK

SEQ ID NO: 581 - protein, 11 aa, BORRELIA OppA
ILERFDLSQLK

SEQ ID NO: 582 - protein, 11 aa, BORRELIA OppA
DKVLINRFGEK

SEQ ID NO: 583 - protein, 11 aa, BORRELIA OppA
RIAIAASSMWK

SEQ ID NO: 584 - protein, 11 aa, BORRELIA OppA
IAIAASSMWKK

SEQ ID NO: 585 - protein, 11 aa, BORRELIA OppA
AIAASSMWKKN

SEQ ID NO: 586 - protein, 12 aa, BORRELIA OppA
IIFFLTFLCCNK

SEQ ID NO: 587 - protein, 12 aa, BORRELIA OppA
DGTVYTFTLREK

SEQ ID NO: 588 - protein, 12 aa, BORRELIA OppA
GTVYTFTLREKI

SEQ ID NO: 589 - protein, 12 aa, BORRELIA OppA
TVYTFTLREKII

SEQ ID NO: 590 - protein, 12 aa, BORRELIA OppA
GIRKSYLRILNK

SEQ ID NO: 591 - protein, 12 aa, BORRELIA OppA
IRKSYLRILNKE

SEQ ID NO: 592 - protein, 12 aa, BORRELIA OppA
RKSYLRILNKET

SEQ ID NO: 593 - protein, 12 aa, BORRELIA OppA
EKTLEITLESPK

SEQ ID NO: 594 - protein, 12 aa, BORRELIA OppA
KTLEITLESPKP

SEQ ID NO: 595 - protein, 12 aa, BORRELIA OppA
AIFSAIPPDLIK

SEQ ID NO: 596 - protein, 12 aa, BORRELIA OppA
AIYFYAFNTHIK

SEQ ID NO: 597 - protein, 12 aa, BORRELIA OppA
TLAIDRETLTYK

SEQ ID NO: 598 - protein, 12 aa, BORRELIA OppA
ITPNFSSYSYAK

SEQ ID NO: 599 - protein, 12 aa, BORRELIA OppA
KNLELFNPEIAK

SEQ ID NO: 600 - protein, 12 aa, BORRELIA OppA
LKLKYNTSEAHK

SEQ ID NO: 601 - protein, 12 aa, BORRELIA OppA
KLKYNTSEAHKK

SEQ ID NO: 602 - protein, 12 aa, BORRELIA OppA
ILRKAEEIIIEK

SEQ ID NO: 603 - protein, 12 aa, BORRELIA OppA
ERFDLSQLKLKK

SEQ ID NO: 604 - protein, 12 aa, BORRELIA OppA
VIFFLTFLCCNK

SEQ ID NO: 605 - protein, 12 aa, BORRELIA OppA
SPENIVTSGPFK

SEQ ID NO: 606 - protein, 12 aa, BORRELIA OppA
AIFGSIPPDLIK

SEQ ID NO: 607 - protein, 12 aa, BORRELIA OppA
AIYFYAFNTYIK

SEQ ID NO: 608 - protein, 12 aa, BORRELIA OppA
IIFFLTFLCCSK

SEQ ID NO: 609 - protein, 12 aa, BORRELIA OppA
TVYTFTLREKIT

SEQ ID NO: 610 - protein, 12 aa, BORRELIA OppA
YLRILNKETGSK

SEQ ID NO: 611 - protein, 12 aa, BORRELIA OppA
SPENMVTSGPFK

SEQ ID NO: 612 - protein, 12 aa, BORRELIA OppA
AIFVSIPPDLIK

SEQ ID NO: 613 - protein, 12 aa, BORRELIA OppA
AIYFYAFNTTVK

SEQ ID NO: 614 - protein, 12 aa, BORRELIA OppA
ATPNFSSYSYAK

SEQ ID NO: 615 - protein, 12 aa, BORRELIA OppA
LKLKYNTSDANK

SEQ ID NO: 616 - protein, 12 aa, BORRELIA OppA
KLKYNTSDANKK

SEQ ID NO: 617 - protein, 12 aa, BORRELIA OppA
ILRQAEEIIIEK

SEQ ID NO: 618 - protein, 12 aa, BORRELIA OppA
TMFRGLITGDPK

SEQ ID NO: 619 - protein, 12 aa, BORRELIA OppA
PKTGGNRPGLAK

SEQ ID NO: 620 - protein, 12 aa, BORRELIA OppA
KTGGNRPGLAKS

SEQ ID NO: 621 - protein, 12 aa, BORRELIA OppA
VNAIYFYAFNTK

SEQ ID NO: 622 - protein, 12 aa, BORRELIA OppA
NAIYFYAFNTKV

SEQ ID NO: 623 - protein, 12 aa, BORRELIA OppA
AIYFYAFNTKVR

SEQ ID NO: 624 - protein, 12 aa, BORRELIA OppA
KVRPLDNVKVRK

SEQ ID NO: 625 - protein, 12 aa, BORRELIA OppA
TLAIDRETLAYK

SEQ ID NO: 626 - protein, 12 aa, BORRELIA OppA
DGTVYTFNLREK

SEQ ID NO: 627 - protein, 12 aa, BORRELIA OppA
GTVYTFNLREKI

SEQ ID NO: 628 - protein, 12 aa, BORRELIA OppA
TVYTFNLREKIT

SEQ ID NO: 629 - protein, 12 aa, BORRELIA OppA
KSLELFNPEIAK

SEQ ID NO: 630 - protein, 12 aa, BORRELIA OppA
SLELFNPEIAKT

SEQ ID NO: 631 - protein, 12 aa, BORRELIA OppA
LKLKYNTNEANK

SEQ ID NO: 632 - protein, 12 aa, BORRELIA OppA
NILERFDLSQLK

SEQ ID NO: 633 - protein, 12 aa, BORRELIA OppA
VVWSWQRLVDPK

SEQ ID NO: 634 - protein, 12 aa, BORRELIA OppA
MLAHPSMVPVDK

SEQ ID NO: 635 - protein, 12 aa, BORRELIA OppA
VDKVLINRFGEK

SEQ ID NO: 636 - protein, 12 aa, BORRELIA OppA
VLINRFGEKWTK

SEQ ID NO: 637 - protein, 12 aa, BORRELIA OppA
KPEHLVTSGAYK

SEQ ID NO: 638 - protein, 12 aa, BORRELIA OppA
RVRKALNMALDK

SEQ ID NO: 639 - protein, 12 aa, BORRELIA OppA
KTPDYASWPMDK

SEQ ID NO: 640 - protein, 12 aa, BORRELIA OppA
QRIAIAASSMWK

SEQ ID NO: 641 - protein, 12 aa, BORRELIA OppA
RIAIAASSMWKK

SEQ ID NO: 642 - protein, 12 aa, BORRELIA OppA
IAIAASSMWKKN

SEQ ID NO: 643 - protein, 12 aa, BORRELIA OppA
AIAASSMWKKNL

SEQ ID NO: 644 - protein, 12 aa, BORRELIA OppA
SMWKKNLGVEAK

SEQ ID NO: 645 - protein, 9 aa, BORRELIA OppA
FLTFLCCNK

SEQ ID NO: 646 - protein, 9 aa, BORRELIA OppA
SKMIDTMFK

SEQ ID NO: 647 - protein, 9 aa, BORRELIA OppA
GGNKPGLAK

SEQ ID NO: 648 - protein, 9 aa, BORRELIA OppA
GTVYTFTLR

SEQ ID NO: 649 - protein, 9 aa, BORRELIA OppA
AITAEGIRK

SEQ ID NO: 650 - protein, 9 aa, BORRELIA OppA
KSYLRILNK

SEQ ID NO: 651 - protein, 9 aa, BORRELIA OppA
GSNYSEMVK

SEQ ID NO: 652 - protein, 9 aa, BORRELIA OppA
NIVTSGPFK

SEQ ID NO: 653 - protein, 9 aa, BORRELIA OppA
VTSGPFKLK

SEQ ID NO: 654 - protein, 9 aa, BORRELIA OppA
TTNDNSTAY

SEQ ID NO: 655 - protein, 9 aa, BORRELIA OppA
TNDNSTAYK

SEQ ID NO: 656 - protein, 9 aa, BORRELIA OppA
SAIPPDLIK

SEQ ID NO: 657 - protein, 9 aa, BORRELIA OppA
SAVNAIYFY

SEQ ID NO: 658 - protein, 9 aa, BORRELIA OppA
AVNAIYFYA

SEQ ID NO: 659 - protein, 9 aa, BORRELIA OppA
KALTLAIDR

SEQ ID NO: 660 - protein, 9 aa, BORRELIA OppA
AIDRETLTY

SEQ ID NO: 661 - protein, 9 aa, BORRELIA OppA
RITPNFSSY

SEQ ID NO: 662 - protein, 9 aa, BORRELIA OppA
NFSSYSYAK

SEQ ID NO: 663 - protein, 9 aa, BORRELIA OppA
ELFNPEIAK

SEQ ID NO: 664 - protein, 9 aa, BORRELIA OppA
NGNGFPILK

SEQ ID NO: 665 - protein, 9 aa, BORRELIA OppA
YTQFSSHNY

SEQ ID NO: 666 - protein, 9 aa, BORRELIA OppA
KAEEIIIEK

SEQ ID NO: 667 - protein, 9 aa, BORRELIA OppA
NSYLFRNDK

SEQ ID NO: 668 - protein, 9 aa, BORRELIA OppA
LSQLKLKNK

SEQ ID NO: 669 - protein, 9 aa, BORRELIA OppA
LTFLSIFTH

SEQ ID NO: 670 - protein, 9 aa, BORRELIA OppA
GSNYAEMVK

SEQ ID NO: 671 - protein, 9 aa, BORRELIA OppA
TTNDSSTAY

SEQ ID NO: 672 - protein, 9 aa, BORRELIA OppA
TNDSSTAYK

SEQ ID NO: 673 - protein, 9 aa, BORRELIA OppA
TAYKMYENK

SEQ ID NO: 674 - protein, 9 aa, BORRELIA OppA
GSIPPDLIK

SEQ ID NO: 675 - protein, 9 aa, BORRELIA OppA
FYAFNTYIK

SEQ ID NO: 676 - protein, 9 aa, BORRELIA OppA
RIAPNFSSY

SEQ ID NO: 677 - protein, 9 aa, BORRELIA OppA
FLTFLCCSK

SEQ ID NO: 678 - protein, 9 aa, BORRELIA OppA
KAKEGVSFK

SEQ ID NO: 679 - protein, 9 aa, BORRELIA OppA
GGNRPGLAK

SEQ ID NO: 680 - protein, 9 aa, BORRELIA OppA
ILNKETGSK

SEQ ID NO: 681 - protein, 9 aa, BORRELIA OppA
GSKYVEMVK

SEQ ID NO: 682 - protein, 9 aa, BORRELIA OppA
KSAIKNGQK

SEQ ID NO: 683 - protein, 9 aa, BORRELIA OppA
NMVTSGPFK

SEQ ID NO: 684 - protein, 9 aa, BORRELIA OppA
VSIPPDLIK

SEQ ID NO: 685 - protein, 9 aa, BORRELIA OppA
TVKPLDNVK

SEQ ID NO: 686 - protein, 9 aa, BORRELIA OppA
SEYNELIKK

SEQ ID NO: 687 - protein, 9 aa, BORRELIA OppA
QAEEIIIEK

SEQ ID NO: 688 - protein, 9 aa, BORRELIA OppA
RGLITGDPK

SEQ ID NO: 689 - protein, 9 aa, BORRELIA OppA
IYFYAFNTK

SEQ ID NO: 690 - protein, 9 aa, BORRELIA OppA
AIDRETLAY

SEQ ID NO: 691 - protein, 9 aa, BORRELIA OppA
LTFLCCNNK

SEQ ID NO: 692 - protein, 9 aa, BORRELIA OppA
GTVYTFNLR

SEQ ID NO: 693 - protein, 9 aa, BORRELIA OppA
KSVIKNGQK

SEQ ID NO: 694 - protein, 9 aa, BORRELIA OppA
EIQPRLAEK

SEQ ID NO: 695 - protein, 9 aa, BORRELIA OppA
RLAEKWENK

SEQ ID NO: 696 - protein, 9 aa, BORRELIA OppA
NTVWTFHLR

SEQ ID NO: 697 - protein, 9 aa, BORRELIA OppA
SWQRLVDPK

SEQ ID NO: 698 - protein, 9 aa, BORRELIA OppA
KTASPYASY

SEQ ID NO: 699 - protein, 9 aa, BORRELIA OppA
VLINRFGEK

SEQ ID NO: 700 - protein, 9 aa, BORRELIA OppA
HLVTSGAYK

SEQ ID NO: 701 - protein, 9 aa, BORRELIA OppA
LSQWVVNER

SEQ ID NO: 702 - protein, 9 aa, BORRELIA OppA
RIVAERNPR

SEQ ID NO: 703 - protein, 9 aa, BORRELIA OppA
KALNMALDK

SEQ ID NO: 704 - protein, 9 aa, BORRELIA OppA
AIAASSMWK

SEQ ID NO: 705 - protein, 9 aa, BORRELIA OppA
IAASSMWKK

SEQ ID NO: 706 - protein, 9 aa, BORRELIA OppA
AATFLNNFR

SEQ ID NO: 707 - protein, 9 aa, BORRELIA OppA
ALVNAAKAK

SEQ ID NO: 708 - protein, 9 aa, BORRELIA OppA
TTQERGQFY

SEQ ID NO: 709 - protein, 9 aa, BORRELIA OppA
AIPVYHYVR

SEQ ID NO: 710 - protein, 9 aa, BORRELIA OppA
WVGGFTPDK

SEQ ID NO: 711 - protein, 9 aa, BORRELIA OppA
YTKDMYIKK

SEQ ID NO: 712 - protein, 10 aa, BORRELIA OppA
GSKMIDTMFK

SEQ ID NO: 713 - protein, 10 aa, BORRELIA OppA
TVYTFTLREK

SEQ ID NO: 714 - protein, 10 aa, BORRELIA OppA
VAITAEGIRK

SEQ ID NO: 715 - protein, 10 aa, BORRELIA OppA
RKSYLRILNK

SEQ ID NO: 716 - protein, 10 aa, BORRELIA OppA
KSYLRILNKE

SEQ ID NO: 717 - protein, 10 aa, BORRELIA OppA
TGSNYSEMVK

SEQ ID NO: 718 - protein, 10 aa, BORRELIA OppA
YSEMVKSTIK

SEQ ID NO: 719 - protein, 10 aa, BORRELIA OppA
TLEITLESPK

SEQ ID NO: 720 - protein, 10 aa, BORRELIA OppA
ENIVTSGPFK

SEQ ID NO: 721 - protein, 10 aa, BORRELIA OppA
IVTSGPFKLK

SEQ ID NO: 722 - protein, 10 aa, BORRELIA OppA
VTSGPFKLKE

SEQ ID NO: 723 - protein, 10 aa, BORRELIA OppA
TTNDNSTAYK

SEQ ID NO: 724 - protein, 10 aa, BORRELIA OppA
FSAIPPDLIK

SEQ ID NO: 725 - protein, 10 aa, BORRELIA OppA
SSAVNAIYFY

SEQ ID NO: 726 - protein, 10 aa, BORRELIA OppA
AIYFYAFNTH

SEQ ID NO: 727 - protein, 10 aa, BORRELIA OppA
YFYAFNTHIK

SEQ ID NO: 728 - protein, 10 aa, BORRELIA OppA
KPLDNVKVRK

SEQ ID NO: 729 - protein, 10 aa, BORRELIA OppA
AIDRETLTYK

SEQ ID NO: 730 - protein, 10 aa, BORRELIA OppA
ITPNFSSYSY

SEQ ID NO: 731 - protein, 10 aa, BORRELIA OppA
LELFNPEIAK

SEQ ID NO: 732 - protein, 10 aa, BORRELIA OppA
KSNGNYEIAR

SEQ ID NO: 733 - protein, 10 aa, BORRELIA OppA
GYTQFSSHNY

SEQ ID NO: 734 - protein, 10 aa, BORRELIA OppA
SSHNYSSPEY

SEQ ID NO: 735 - protein, 10 aa, BORRELIA OppA
SSPEYNELIK

SEQ ID NO: 736 - protein, 10 aa, BORRELIA OppA
KSDLELDPIK

SEQ ID NO: 737 - protein, 10 aa, BORRELIA OppA
RKAEEIIIEK

SEQ ID NO: 738 - protein, 10 aa, BORRELIA OppA
APIYIYGNSY

SEQ ID NO: 739 - protein, 10 aa, BORRELIA OppA
YIYGNSYLFR

SEQ ID NO: 740 - protein, 10 aa, BORRELIA OppA
GNSYLFRNDK

SEQ ID NO: 741 - protein, 10 aa, BORRELIA OppA
GSKMIDTMFR

SEQ ID NO: 742 - protein, 10 aa, BORRELIA OppA
TGSNYAEMVK

SEQ ID NO: 743 - protein, 10 aa, BORRELIA OppA
YAEMVKSTIK

SEQ ID NO: 744 - protein, 10 aa, BORRELIA OppA
TTNDSSTAYK

SEQ ID NO: 745 - protein, 10 aa, BORRELIA OppA
STAYKMYENK

SEQ ID NO: 746 - protein, 10 aa, BORRELIA OppA
FGSIPPDLIK

SEQ ID NO: 747 - protein, 10 aa, BORRELIA OppA
AIYFYAFNTY

SEQ ID NO: 748 - protein, 10 aa, BORRELIA OppA
YFYAFNTYIK

SEQ ID NO: 749 - protein, 10 aa, BORRELIA OppA
RRIAPNFSSY

SEQ ID NO: 750 - protein, 10 aa, BORRELIA OppA
IAPNFSSYSY

SEQ ID NO: 751 - protein, 10 aa, BORRELIA OppA
RSNGNYEIAR

SEQ ID NO: 752 - protein, 10 aa, BORRELIA OppA
LTFLCCSKEK

SEQ ID NO: 753 - protein, 10 aa, BORRELIA OppA
QLAEDNVASK

SEQ ID NO: 754 - protein, 10 aa, BORRELIA OppA
ASKMIDTMFR

SEQ ID NO: 755 - protein, 10 aa, BORRELIA OppA
RILNKETGSK

SEQ ID NO: 756 - protein, 10 aa, BORRELIA OppA
TGSKYVEMVK

SEQ ID NO: 757 - protein, 10 aa, BORRELIA OppA
YVEMVKSAIK

SEQ ID NO: 758 - protein, 10 aa, BORRELIA OppA
MVTSGPFKLK

SEQ ID NO: 759 - protein, 10 aa, BORRELIA OppA
FVSIPPDLIK

SEQ ID NO: 760 - protein, 10 aa, BORRELIA OppA
VSIPPDLIKD

SEQ ID NO: 761 - protein, 10 aa, BORRELIA OppA
YFYAFNTTVK

SEQ ID NO: 762 - protein, 10 aa, BORRELIA OppA
TTVKPLDNVK

SEQ ID NO: 763 - protein, 10 aa, BORRELIA OppA
ATPNFSSYSY

SEQ ID NO: 764 - protein, 10 aa, BORRELIA OppA
SSHNYSNSEY

SEQ ID NO: 765 - protein, 10 aa, BORRELIA OppA
SNSEYNELIK

SEQ ID NO: 766 - protein, 10 aa, BORRELIA OppA
NSEYNELIKK

SEQ ID NO: 767 - protein, 10 aa, BORRELIA OppA
RQAEEIIIEK

SEQ ID NO: 768 - protein, 10 aa, BORRELIA OppA
VPITAEGIRK

SEQ ID NO: 769 - protein, 10 aa, BORRELIA OppA
AIYFYAFNTK

SEQ ID NO: 770 - protein, 10 aa, BORRELIA OppA
RPLDNVKVRK

SEQ ID NO: 771 - protein, 10 aa, BORRELIA OppA
AIDRETLAYK

SEQ ID NO: 772 - protein, 10 aa, BORRELIA OppA
FLTFLCCNNK

SEQ ID NO: 773 - protein, 10 aa, BORRELIA OppA
TVYTFNLREK

SEQ ID NO: 774 - protein, 10 aa, BORRELIA OppA
YVEMVKSVIK

SEQ ID NO: 775 - protein, 10 aa, BORRELIA OppA
KPLDNVKIRK

SEQ ID NO: 776 - protein, 10 aa, BORRELIA OppA
SSHNYSNPEY

SEQ ID NO: 777 - protein, 10 aa, BORRELIA OppA
GEIQPRLAEK

SEQ ID NO: 778 - protein, 10 aa, BORRELIA OppA
WSWQRLVDPK

SEQ ID NO: 779 - protein, 10 aa, BORRELIA OppA
KQAPDTLGVK

SEQ ID NO: 780 - protein, 10 aa, BORRELIA OppA
KVLINRFGEK

SEQ ID NO: 781 - protein, 10 aa, BORRELIA OppA
EHLVTSGAYK

SEQ ID NO: 782 - protein, 10 aa, BORRELIA OppA
KLSQWVVNER

SEQ ID NO: 783 - protein, 10 aa, BORRELIA OppA
SEAADVNRYK

SEQ ID NO: 784 - protein, 10 aa, BORRELIA OppA
VPINQFAQLK

SEQ ID NO: 785 - protein, 10 aa, BORRELIA OppA
VSPQLATYYY

SEQ ID NO: 786 - protein, 10 aa, BORRELIA OppA
RKALNMALDK

SEQ ID NO: 787 - protein, 10 aa, BORRELIA OppA
ALDKDIIADK

SEQ ID NO: 788 - protein, 10 aa, BORRELIA OppA
IAIAASSMWK

SEQ ID NO: 789 - protein, 10 aa, BORRELIA OppA
AIAASSMWKK

SEQ ID NO: 790 - protein, 10 aa, BORRELIA OppA
KTMLDTMHTH

SEQ ID NO: 791 - protein, 10 aa, BORRELIA OppA
AVRYAWIADY

SEQ ID NO: 792 - protein, 10 aa, BORRELIA OppA
YDQALVNAAK

SEQ ID NO: 793 - protein, 10 aa, BORRELIA OppA
YYTKDMYIKK

SEQ ID NO: 794 - protein, 11 aa, BORRELIA OppA
VGSKMIDTMFK

SEQ ID NO: 795 - protein, 11 aa, BORRELIA OppA
GSKMIDTMFKG

SEQ ID NO: 796 - protein, 11 aa, BORRELIA OppA
GTVYTFTLREK

SEQ ID NO: 797 - protein, 11 aa, BORRELIA OppA
TVYTFTLREKI

SEQ ID NO: 798 - protein, 11 aa, BORRELIA OppA
GVAITAEGIRK

SEQ ID NO: 799 - protein, 11 aa, BORRELIA OppA
IRKSYLRILNK

SEQ ID NO: 800 - protein, 11 aa, BORRELIA OppA
KTLEITLESPK

SEQ ID NO: 801 - protein, 11 aa, BORRELIA OppA
NIVTSGPFKLK

SEQ ID NO: 802 - protein, 11 aa, BORRELIA OppA
RIPNEKYVVEK

SEQ ID NO: 803 - protein, 11 aa, BORRELIA OppA
YTTNDNSTAYK

SEQ ID NO: 804 - protein, 11 aa, BORRELIA OppA
TTNDNSTAYKM

SEQ ID NO: 805 - protein, 11 aa, BORRELIA OppA
YSSAVNAIYFY

SEQ ID NO: 806 - protein, 11 aa, BORRELIA OppA
LAIDRETLTYK

SEQ ID NO: 807 - protein, 11 aa, BORRELIA OppA
YSSPEYNELIK

SEQ ID NO: 808 - protein, 11 aa, BORRELIA OppA
SSPEYNELIKK

SEQ ID NO: 809 - protein, 11 aa, BORRELIA OppA
IYIYGNSYLFR

SEQ ID NO: 810 - protein, 11 aa, BORRELIA OppA
ITERFDLSQLK

SEQ ID NO: 811 - protein, 11 aa, BORRELIA OppA
YTTNDSSTAYK

SEQ ID NO: 812 - protein, 11 aa, BORRELIA OppA
TTNDSSTAYKM

SEQ ID NO: 813 - protein, 11 aa, BORRELIA OppA
SSTAYKMYENK

SEQ ID NO: 814 - protein, 11 aa, BORRELIA OppA
STAYKMYENKE

SEQ ID NO: 815 - protein, 11 aa, BORRELIA OppA
IFGSIPPDLIK

SEQ ID NO: 816 - protein, 11 aa, BORRELIA OppA
SIPPDLIKDLK

SEQ ID NO: 817 - protein, 11 aa, BORRELIA OppA
NAIYFYAFNTY

SEQ ID NO: 818 - protein, 11 aa, BORRELIA OppA
VASKMIDTMFR

SEQ ID NO: 819 - protein, 11 aa, BORRELIA OppA
NMVTSGPFKLK

SEQ ID NO: 820 - protein, 11 aa, BORRELIA OppA
IFVSIPPDLIK

SEQ ID NO: 821 - protein, 11 aa, BORRELIA OppA
RATPNFSSYSY

SEQ ID NO: 822 - protein, 11 aa, BORRELIA OppA
ATFLSIFTQGY

SEQ ID NO: 823 - protein, 11 aa, BORRELIA OppA
YSNSEYNELIK

SEQ ID NO: 824 - protein, 11 aa, BORRELIA OppA
ISERFDLSQLK

SEQ ID NO: 825 - protein, 11 aa, BORRELIA OppA
KTGGNRPGLAK

SEQ ID NO: 826 - protein, 11 aa, BORRELIA OppA
RIPNEKYVFEK

SEQ ID NO: 827 - protein, 11 aa, BORRELIA OppA
NAIYFYAFNTK

SEQ ID NO: 828 - protein, 11 aa, BORRELIA OppA
AIYFYAFNTKV

SEQ ID NO: 829 - protein, 11 aa, BORRELIA OppA
LAIDRETLAYK

SEQ ID NO: 830 - protein, 11 aa, BORRELIA OppA
GTVYTFNLREK

SEQ ID NO: 831 - protein, 11 aa, BORRELIA OppA
TVYTFNLREKI

SEQ ID NO: 832 - protein, 11 aa, BORRELIA OppA
SIPPDLIKNLK

SEQ ID NO: 833 - protein, 11 aa, BORRELIA OppA
SLELFNPEIAK

SEQ ID NO: 834 - protein, 11 aa, BORRELIA OppA
YSNPEYNELIK

SEQ ID NO: 835 - protein, 11 aa, BORRELIA OppA
ILERFDLSQLK

SEQ ID NO: 836 - protein, 11 aa, BORRELIA OppA
TGEIQPRLAEK

SEQ ID NO: 837 - protein, 11 aa, BORRELIA OppA
IVNGAAIAQGK

SEQ ID NO: 838 - protein, 11 aa, BORRELIA OppA
LAHPSMVPVDK

SEQ ID NO: 839 - protein, 11 aa, BORRELIA OppA
DKVLINRFGEK

SEQ ID NO: 840 - protein, 11 aa, BORRELIA OppA
LINRFGEKWTK

SEQ ID NO: 841 - protein, 11 aa, BORRELIA OppA
TSEAADVNRYK

SEQ ID NO: 842 - protein, 11 aa, BORRELIA OppA
TVPINQFAQLK

SEQ ID NO: 843 - protein, 11 aa, BORRELIA OppA
ATYYYEFNTTR

SEQ ID NO: 844 - protein, 11 aa, BORRELIA OppA
SQPDIGGVTLK

SEQ ID NO: 845 - protein, 11 aa, BORRELIA OppA
ASHPLSFNLLY

SEQ ID NO: 846 - protein, 11 aa, BORRELIA OppA
RIAIAASSMWK

SEQ ID NO: 847 - protein, 11 aa, BORRELIA OppA
IAIAASSMWKK

SEQ ID NO: 848 - protein, 11 aa, BORRELIA OppA
AIAASSMWKKN

SEQ ID NO: 849 - protein, 11 aa, BORRELIA OppA
YYYTKDMYIKK

SEQ ID NO: 850 - protein, 12 aa, BORRELIA OppA
IIFFLTFLCCNK

SEQ ID NO: 851 - protein, 12 aa, BORRELIA OppA
NVGSKMIDTMFK

SEQ ID NO: 852 - protein, 12 aa, BORRELIA OppA
VGSKMIDTMFKG

SEQ ID NO: 853 - protein, 12 aa, BORRELIA OppA
GSKMIDTMFKGL

SEQ ID NO: 854 - protein, 12 aa, BORRELIA OppA
DGTVYTFTLREK

SEQ ID NO: 855 - protein, 12 aa, BORRELIA OppA
GTVYTFTLREKI

SEQ ID NO: 856 - protein, 12 aa, BORRELIA OppA
TVYTFTLREKII

SEQ ID NO: 857 - protein, 12 aa, BORRELIA OppA
GIRKSYLRILNK

SEQ ID NO: 858 - protein, 12 aa, BORRELIA OppA
KETGSNYSEMVK

SEQ ID NO: 859 - protein, 12 aa, BORRELIA OppA
EKTLEITLESPK

SEQ ID NO: 860 - protein, 12 aa, BORRELIA OppA
KTLEITLESPKP

SEQ ID NO: 861 - protein, 12 aa, BORRELIA OppA
ENIVTSGPFKLK

SEQ ID NO: 862 - protein, 12 aa, BORRELIA OppA
FYTTNDNSTAYK

SEQ ID NO: 863 - protein, 12 aa, BORRELIA OppA
YTTNDNSTAYKM

SEQ ID NO: 864 - protein, 12 aa, BORRELIA OppA
TTNDNSTAYKMY

SEQ ID NO: 865 - protein, 12 aa, BORRELIA OppA
AIFSAIPPDLIK

SEQ ID NO: 866 - protein, 12 aa, BORRELIA OppA
SAIPPDLIKDLK

SEQ ID NO: 867 - protein, 12 aa, BORRELIA OppA
YYSSAVNAIYFY

SEQ ID NO: 868 - protein, 12 aa, BORRELIA OppA
AIYFYAFNTHIK

SEQ ID NO: 869 - protein, 12 aa, BORRELIA OppA
TLAIDRETLTYK

SEQ ID NO: 870 - protein, 12 aa, BORRELIA OppA
ITPNFSSYSYAK

SEQ ID NO: 871 - protein, 12 aa, BORRELIA OppA
KNLELFNPEIAK

SEQ ID NO: 872 - protein, 12 aa, BORRELIA OppA
KICEFIQNQWKK

SEQ ID NO: 873 - protein, 12 aa, BORRELIA OppA
NYSSPEYNELIK

SEQ ID NO: 874 - protein, 12 aa, BORRELIA OppA
YSSPEYNELIKK

SEQ ID NO: 875 - protein, 12 aa, BORRELIA OppA
SSPEYNELIKKS

SEQ ID NO: 876 - protein, 12 aa, BORRELIA OppA
PIYIYGNSYLFR

SEQ ID NO: 877 - protein, 12 aa, BORRELIA OppA
IYGNSYLFRNDK

SEQ ID NO: 878 - protein, 12 aa, BORRELIA OppA
NITERFDLSQLK

SEQ ID NO: 879 - protein, 12 aa, BORRELIA OppA
VIFFLTFLCCNK

SEQ ID NO: 880 - protein, 12 aa, BORRELIA OppA
KETGSNYAEMVK

SEQ ID NO: 881 - protein, 12 aa, BORRELIA OppA
SPENIVTSGPFK

SEQ ID NO: 882 - protein, 12 aa, BORRELIA OppA
FYTTNDSSTAYK

SEQ ID NO: 883 - protein, 12 aa, BORRELIA OppA
YTTNDSSTAYKM

SEQ ID NO: 884 - protein, 12 aa, BORRELIA OppA
TTNDSSTAYKMY

SEQ ID NO: 885 - protein, 12 aa, BORRELIA OppA
DSSTAYKMYENK

SEQ ID NO: 886 - protein, 12 aa, BORRELIA OppA
SSTAYKMYENKE

SEQ ID NO: 887 - protein, 12 aa, BORRELIA OppA
STAYKMYENKEL

SEQ ID NO: 888 - protein, 12 aa, BORRELIA OppA
AIFGSIPPDLIK

SEQ ID NO: 889 - protein, 12 aa, BORRELIA OppA
GSIPPDLIKDLK

SEQ ID NO: 890 - protein, 12 aa, BORRELIA OppA
VNAIYFYAFNTY

SEQ ID NO: 891 - protein, 12 aa, BORRELIA OppA
AIYFYAFNTYIK

SEQ ID NO: 892 - protein, 12 aa, BORRELIA OppA
IAPNFSSYSYAK

SEQ ID NO: 893 - protein, 12 aa, BORRELIA OppA
IIFFLTFLCCSK

SEQ ID NO: 894 - protein, 12 aa, BORRELIA OppA
NVASKMIDTMFR

SEQ ID NO: 895 - protein, 12 aa, BORRELIA OppA
TVYTFTLREKIT

SEQ ID NO: 896 - protein, 12 aa, BORRELIA OppA
SPENMVTSGPFK

SEQ ID NO: 897 - protein, 12 aa, BORRELIA OppA
ENMVTSGPFKLK

SEQ ID NO: 898 - protein, 12 aa, BORRELIA OppA
AIFVSIPPDLIK

SEQ ID NO: 899 - protein, 12 aa, BORRELIA OppA
VSIPPDLIKDLK

SEQ ID NO: 900 - protein, 12 aa, BORRELIA OppA
AIYFYAFNTTVK

SEQ ID NO: 901 - protein, 12 aa, BORRELIA OppA
RRATPNFSSYSY

SEQ ID NO: 902 - protein, 12 aa, BORRELIA OppA
ATPNFSSYSYAK

SEQ ID NO: 903 - protein, 12 aa, BORRELIA OppA
PATFLSIFTQGY

SEQ ID NO: 904 - protein, 12 aa, BORRELIA OppA
YSNSEYNELIKK

SEQ ID NO: 905 - protein, 12 aa, BORRELIA OppA
NISERFDLSQLK

SEQ ID NO: 906 - protein, 12 aa, BORRELIA OppA
TMFRGLITGDPK

SEQ ID NO: 907 - protein, 12 aa, BORRELIA OppA
PKTGGNRPGLAK

SEQ ID NO: 908 - protein, 12 aa, BORRELIA OppA
ERIPNEKYVFEK

SEQ ID NO: 909 - protein, 12 aa, BORRELIA OppA
VNAIYFYAFNTK

SEQ ID NO: 910 - protein, 12 aa, BORRELIA OppA
NAIYFYAFNTKV

SEQ ID NO: 911 - protein, 12 aa, BORRELIA OppA
AIYFYAFNTKVR

SEQ ID NO: 912 - protein, 12 aa, BORRELIA OppA
TLAIDRETLAYK

SEQ ID NO: 913 - protein, 12 aa, BORRELIA OppA
DGTVYTFNLREK

SEQ ID NO: 914 - protein, 12 aa, BORRELIA OppA
GTVYTFNLREKI

SEQ ID NO: 915 - protein, 12 aa, BORRELIA OppA
TVYTFNLREKIT

SEQ ID NO: 916 - protein, 12 aa, BORRELIA OppA
GSIPPDLIKNLK

SEQ ID NO: 917 - protein, 12 aa, BORRELIA OppA
KSLELFNPEIAK

SEQ ID NO: 918 - protein, 12 aa, BORRELIA OppA
NYSNPEYNELIK

SEQ ID NO: 919 - protein, 12 aa, BORRELIA OppA
YSNPEYNELIKK

SEQ ID NO: 920 - protein, 12 aa, BORRELIA OppA
NILERFDLSQLK

SEQ ID NO: 921 - protein, 12 aa, BORRELIA OppA
PTGEIQPRLAEK

SEQ ID NO: 922 - protein, 12 aa, BORRELIA OppA
VVWSWQRLVDPK

SEQ ID NO: 923 - protein, 12 aa, BORRELIA OppA
HIVNGAAIAQGK

SEQ ID NO: 924 - protein, 12 aa, BORRELIA OppA
MLAHPSMVPVDK

SEQ ID NO: 925 - protein, 12 aa, BORRELIA OppA
VDKVLINRFGEK

SEQ ID NO: 926 - protein, 12 aa, BORRELIA OppA
VLINRFGEKWTK

SEQ ID NO: 927 - protein, 12 aa, BORRELIA OppA
KPEHLVTSGAYK

SEQ ID NO: 928 - protein, 12 aa, BORRELIA OppA
ITSEAADVNRYK

SEQ ID NO: 929 - protein, 12 aa, BORRELIA OppA
YTVPINQFAQLK

SEQ ID NO: 930 - protein, 12 aa, BORRELIA OppA
TVPINQFAQLKK

SEQ ID NO: 931 - protein, 12 aa, BORRELIA OppA
LATYYYEFNTTR

SEQ ID NO: 932 - protein, 12 aa, BORRELIA OppA
RVRKALNMALDK

SEQ ID NO: 933 - protein, 12 aa, BORRELIA OppA
ISQPDIGGVTLK

SEQ ID NO: 934 - protein, 12 aa, BORRELIA OppA
KTPDYASWPMDK

SEQ ID NO: 935 - protein, 12 aa, BORRELIA OppA
NASHPLSFNLLY

SEQ ID NO: 936 - protein, 12 aa, BORRELIA OppA
QRIAIAASSMWK

SEQ ID NO: 937 - protein, 12 aa, BORRELIA OppA
RIAIAASSMWKK

SEQ ID NO: 938 - protein, 12 aa, BORRELIA OppA
SMWKKNLGVEAK

SEQ ID NO: 939 - protein, 12 aa, BORRELIA OppA
FTPDKLGYYYTK

SEQ ID NO: 940 - protein, 12 aa, BORRELIA OppA
GYYYTKDMYIKK

SEQ ID NO: 941 - protein, 9 aa, BORRELIA OppA
KLQKLLFLI

SEQ ID NO: 942 - protein, 9 aa, BORRELIA OppA
FLIIFFLTF

SEQ ID NO: 943 - protein, 9 aa, BORRELIA OppA
IDMLVHQSF

SEQ ID NO: 944 - protein, 9 aa, BORRELIA OppA
SFIPIPIHI

SEQ ID NO: 945 - protein, 9 aa, BORRELIA OppA
YYSSAVNAI

SEQ ID NO: 946 - protein, 9 aa, BORRELIA OppA
VNAIYFYAF

SEQ ID NO: 947 - protein, 9 aa, BORRELIA OppA
IYFYAFNTH

SEQ ID NO: 948 - protein, 9 aa, BORRELIA OppA
YFYAFNTHI

SEQ ID NO: 949 - protein, 9 aa, BORRELIA OppA
SYAKNLELF

SEQ ID NO: 950 - protein, 9 aa, BORRELIA OppA
IFTQGYTQF

SEQ ID NO: 951 - protein, 9 aa, BORRELIA OppA
IYIYGNSYL

SEQ ID NO: 952 - protein, 9 aa, BORRELIA OppA
YIYGNSYLF

SEQ ID NO: 953 - protein, 9 aa, BORRELIA OppA
SYLFRNDKW

SEQ ID NO: 954 - protein, 9 aa, BORRELIA OppA
KWTGWNTNI

SEQ ID NO: 955 - protein, 9 aa, BORRELIA OppA
IYFYAFNTY

SEQ ID NO: 956 - protein, 9 aa, BORRELIA OppA
YFYAFNTYI

SEQ ID NO: 957 - protein, 9 aa, BORRELIA OppA
KLQKSLFLI

SEQ ID NO: 958 - protein, 9 aa, BORRELIA OppA
IYFYAFNTT

SEQ ID NO: 959 - protein, 9 aa, BORRELIA OppA
RIPNEKYVF

SEQ ID NO: 960 - protein, 9 aa, BORRELIA OppA
KLQRSLFLI

SEQ ID NO: 961 - protein, 9 aa, BORRELIA OppA
RSLFLIIFF

SEQ ID NO: 962 - protein, 9 aa, BORRELIA OppA
SYAKSLELF

SEQ ID NO: 963 - protein, 9 aa, BORRELIA OppA
SYPGNMHIV

SEQ ID NO: 964 - protein, 9 aa, BORRELIA OppA
RYWDNAHTV

SEQ ID NO: 965 - protein, 9 aa, BORRELIA OppA
YWDNAHTVI

SEQ ID NO: 966 - protein, 9 aa, BORRELIA OppA
VYTVPINQF

SEQ ID NO: 967 - protein, 9 aa, BORRELIA OppA
QLATYYYEF

SEQ ID NO: 968 - protein, 9 aa, BORRELIA OppA
FYQQAEDLL

SEQ ID NO: 969 - protein, 9 aa, BORRELIA OppA
VYHYVRTHL

SEQ ID NO: 970 - protein, 9 aa, BORRELIA OppA
YYYTKDMYI

SEQ ID NO: 971 - protein, 10 aa, BORRELIA OppA
LFLIIFFLTF

SEQ ID NO: 972 - protein, 10 aa, BORRELIA OppA
ISPDGTVYTF

SEQ ID NO: 973 - protein, 10 aa, BORRELIA OppA
VYTFTLREKI

SEQ ID NO: 974 - protein, 10 aa, BORRELIA OppA
NYSEMVKSTI

SEQ ID NO: 975 - protein, 10 aa, BORRELIA OppA
IFSAIPPDLI

SEQ ID NO: 976 - protein, 10 aa, BORRELIA OppA
DYYSSAVNAI

SEQ ID NO: 977 - protein, 10 aa, BORRELIA OppA
YYSSAVNAIY

SEQ ID NO: 978 - protein, 10 aa, BORRELIA OppA
IYFYAFNTHI

SEQ ID NO: 979 - protein, 10 aa, BORRELIA OppA
SYSYAKNLEL

SEQ ID NO: 980 - protein, 10 aa, BORRELIA OppA
YSYAKNLELF

SEQ ID NO: 981 - protein, 10 aa, BORRELIA OppA
SYAKNLELFN

SEQ ID NO: 982 - protein, 10 aa, BORRELIA OppA
GYPNGNGFPI

SEQ ID NO: 983 - protein, 10 aa, BORRELIA OppA
SIFTQGYTQF

SEQ ID NO: 984 - protein, 10 aa, BORRELIA OppA
IFTQGYTQFS

SEQ ID NO: 985 - protein, 10 aa, BORRELIA OppA
NYSSPEYNEL

SEQ ID NO: 986 - protein, 10 aa, BORRELIA OppA
IYIYGNSYLF

SEQ ID NO: 987 - protein, 10 aa, BORRELIA OppA
YIYGNSYLFR

SEQ ID NO: 988 - protein, 10 aa, BORRELIA OppA
LFSVIFFLTF

SEQ ID NO: 989 - protein, 10 aa, BORRELIA OppA
NYAEMVKSTI

SEQ ID NO: 990 - protein, 10 aa, BORRELIA OppA
IFGSIPPDLI

SEQ ID NO: 991 - protein, 10 aa, BORRELIA OppA
IYFYAFNTYI

SEQ ID NO: 992 - protein, 10 aa, BORRELIA OppA
KYVEMVKSAI

SEQ ID NO: 993 - protein, 10 aa, BORRELIA OppA
IFVSIPPDLI

SEQ ID NO: 994 - protein, 10 aa, BORRELIA OppA
IYFYAFNTTV

SEQ ID NO: 995 - protein, 10 aa, BORRELIA OppA
NYSNSEYNEL

SEQ ID NO: 996 - protein, 10 aa, BORRELIA OppA
ISSDGTVYTF

SEQ ID NO: 997 - protein, 10 aa, BORRELIA OppA
IYFYAFNTKV

SEQ ID NO: 998 - protein, 10 aa, BORRELIA OppA
VYTFNLREKI

SEQ ID NO: 999 - protein, 10 aa, BORRELIA OppA
KYVEMVKSVI

SEQ ID NO: 1000 - protein, 10 aa, BORRELIA OppA
SYSYAKSLEL

SEQ ID NO: 1001 - protein, 10 aa, BORRELIA OppA
YSYAKSLELF

SEQ ID NO: 1002 - protein, 10 aa, BORRELIA OppA
SYAKSLELFN

SEQ ID NO: 1003 - protein, 10 aa, BORRELIA OppA
NYSNPEYNEL

SEQ ID NO: 1004 - protein, 10 aa, BORRELIA OppA
KWTGWNTNIL

SEQ ID NO: 1005 - protein, 10 aa, BORRELIA OppA
RYWDNAHTVI

SEQ ID NO: 1006 - protein, 10 aa, BORRELIA OppA
IVYTVPINQF

SEQ ID NO: 1007 - protein, 10 aa, BORRELIA OppA
VYTVPINQFA

SEQ ID NO: 1008 - protein, 10 aa, BORRELIA OppA
PQLATYYYEF

SEQ ID NO: 1009 - protein, 10 aa, BORRELIA OppA
VYHYVRTHLV

SEQ ID NO: 1010 - protein, 10 aa, BORRELIA OppA
GYYYTKDMYI

SEQ ID NO: 1011 - protein, 11 aa, BORRELIA OppA
YFIDMLVHQSF

SEQ ID NO: 1012 - protein, 11 aa, BORRELIA OppA
YYSSAVNAIYF

SEQ ID NO: 1013 - protein, 11 aa, BORRELIA OppA
AIYFYAFNTHI

SEQ ID NO: 1014 - protein, 11 aa, BORRELIA OppA
IYFYAFNTHIK

SEQ ID NO: 1015 - protein, 11 aa, BORRELIA OppA
SYSYAKNLELF

SEQ ID NO: 1016 - protein, 11 aa, BORRELIA OppA
YSYAKNLELFN

SEQ ID NO: 1017 - protein, 11 aa, BORRELIA OppA
SYAKNLELFNP

SEQ ID NO: 1018 - protein, 11 aa, BORRELIA OppA
PIYIYGNSYLF

SEQ ID NO: 1019 - protein, 11 aa, BORRELIA OppA
IYIYGNSYLFR

SEQ ID NO: 1020 - protein, 11 aa, BORRELIA OppA
AIYFYAFNTYI

SEQ ID NO: 1021 - protein, 11 aa, BORRELIA OppA
IYFYAFNTYIK

SEQ ID NO: 1022 - protein, 11 aa, BORRELIA OppA
FYAFNTYIKPL

SEQ ID NO: 1023 - protein, 11 aa, BORRELIA OppA
SYSYAKSLELF

SEQ ID NO: 1024 - protein, 11 aa, BORRELIA OppA
YSYAKSLELFN

SEQ ID NO: 1025 - protein, 11 aa, BORRELIA OppA
SYAKSLELFNP

SEQ ID NO: 1026 - protein, 11 aa, BORRELIA OppA
YYEFNTTRPPF

SEQ ID NO: 1027 - protein, 11 aa, BORRELIA OppA
DYASWPMDKRI

SEQ ID NO: 1028 - protein, 12 aa, BORRELIA OppA
PYFIDMLVHQSF

SEQ ID NO: 1029 - protein, 12 aa, BORRELIA OppA
YFIDMLVHQSFI

SEQ ID NO: 1030 - protein, 12 aa, BORRELIA OppA
RSDYYSSAVNAI

SEQ ID NO: 1031 - protein, 12 aa, BORRELIA OppA
DYYSSAVNAIYF

SEQ ID NO: 1032 - protein, 12 aa, BORRELIA OppA
YYSSAVNAIYFY

SEQ ID NO: 1033 - protein, 12 aa, BORRELIA OppA
NAIYFYAFNTHI

SEQ ID NO: 1034 - protein, 12 aa, BORRELIA OppA
AIYFYAFNTHIK

SEQ ID NO: 1035 - protein, 12 aa, BORRELIA OppA
IYFYAFNTHIKP

SEQ ID NO: 1036 - protein, 12 aa, BORRELIA OppA
SSYSYAKNLELF

SEQ ID NO: 1037 - protein, 12 aa, BORRELIA OppA
SYSYAKNLELFN

SEQ ID NO: 1038 - protein, 12 aa, BORRELIA OppA
YSYAKNLELFNP

SEQ ID NO: 1039 - protein, 12 aa, BORRELIA OppA
SYAKNLELFNPE

SEQ ID NO: 1040 - protein, 12 aa, BORRELIA OppA
GWIGDYADPLTF

SEQ ID NO: 1041 - protein, 12 aa, BORRELIA OppA
APIYIYGNSYLF

SEQ ID NO: 1042 - protein, 12 aa, BORRELIA OppA
PIYIYGNSYLFR

SEQ ID NO: 1043 - protein, 12 aa, BORRELIA OppA
IYIYGNSYLFRN

SEQ ID NO: 1044 - protein, 12 aa, BORRELIA OppA
NAIYFYAFNTYI

SEQ ID NO: 1045 - protein, 12 aa, BORRELIA OppA
AIYFYAFNTYIK

SEQ ID NO: 1046 - protein, 12 aa, BORRELIA OppA
IYFYAFNTYIKP

SEQ ID NO: 1047 - protein, 12 aa, BORRELIA OppA
VYTFTLREKITW

SEQ ID NO: 1048 - protein, 12 aa, BORRELIA OppA
RNDYYSSAVNAI

SEQ ID NO: 1049 - protein, 12 aa, BORRELIA OppA
RSLFLIIFFLTF

SEQ ID NO: 1050 - protein, 12 aa, BORRELIA OppA
VYTFNLREKITW

SEQ ID NO: 1051 - protein, 12 aa, BORRELIA OppA
SSYSYAKSLELF

SEQ ID NO: 1052 - protein, 12 aa, BORRELIA OppA
SYSYAKSLELFN

SEQ ID NO: 1053 - protein, 12 aa, BORRELIA OppA
YSYAKSLELFNP

SEQ ID NO: 1054 - protein, 12 aa, BORRELIA OppA
SYAKSLELFNPE

SEQ ID NO: 1055 - protein, 12 aa, BORRELIA OppA
KWENKDNTVWTF

SEQ ID NO: 1056 - protein, 12 aa, BORRELIA OppA
VSPQLATYYYEF

SEQ ID NO: 1057 - protein, 12 aa, BORRELIA OppA
YYYEFNTTRPPF

SEQ ID NO: 1058 - protein, 12 aa, BORRELIA OppA
YYEFNTTRPPFN

SEQ ID NO: 1059 - protein, 12 aa, BORRELIA OppA
AWIADYDDAATF

SEQ ID NO: 1060 - protein, 9 aa, BORRELIA OppA
ETGSNYSEM

SEQ ID NO: 1061 - protein, 9 aa, BORRELIA OppA
YVVEKNDKY

SEQ ID NO: 1062 - protein, 9 aa, BORRELIA OppA
TTNDNSTAY

SEQ ID NO: 1063 - protein, 9 aa, BORRELIA OppA
RITPNFSSY

SEQ ID NO: 1064 - protein, 9 aa, BORRELIA OppA
PIYIYGNSY

SEQ ID NO: 1065 - protein, 9 aa, BORRELIA OppA
TTNDSSTAY

SEQ ID NO: 1066 - protein, 9 aa, BORRELIA OppA
RIAPNFSSY

SEQ ID NO: 1067 - protein, 9 aa, BORRELIA OppA
YVFEKNDKY

SEQ ID NO: 1068 - protein, 9 aa, BORRELIA OppA
YVFEKNNKY

SEQ ID NO: 1069 - protein, 9 aa, BORRELIA OppA
KTASPYASY

SEQ ID NO: 1070 - protein, 9 aa, BORRELIA OppA
HTVINKVTY

SEQ ID NO: 1071 - protein, 9 aa, BORRELIA OppA
DVSPQLATY

SEQ ID NO: 1072 - protein, 9 aa, BORRELIA OppA
FTPDKLGYY

SEQ ID NO: 1073 - protein, 9 aa, BORRELIA OppA
ETGSNYSEM

SEQ ID NO: 1074 - protein, 9 aa, BORRELIA OppA
STIKNGQKY

SEQ ID NO: 1075 - protein, 9 aa, BORRELIA OppA
YVVEKNDKY

SEQ ID NO: 1076 - protein, 9 aa, BORRELIA OppA
TTNDNSTAY

SEQ ID NO: 1077 - protein, 9 aa, BORRELIA OppA
YSSAVNAIY

SEQ ID NO: 1078 - protein, 9 aa, BORRELIA OppA
SAVNAIYFY

SEQ ID NO: 1079 - protein, 9 aa, BORRELIA OppA
EAHKKICEF

SEQ ID NO: 1080 - protein, 9 aa, BORRELIA OppA
YTQFSSHNY

SEQ ID NO: 1081 - protein, 9 aa, BORRELIA OppA
YIYGNSYLF

SEQ ID NO: 1082 - protein, 9 aa, BORRELIA OppA
SVIFFLTFL

SEQ ID NO: 1083 - protein, 9 aa, BORRELIA OppA
ETGSNYAEM

SEQ ID NO: 1084 - protein, 9 aa, BORRELIA OppA
TTNDSSTAY

SEQ ID NO: 1085 - protein, 9 aa, BORRELIA OppA
DSSTAYKMY

SEQ ID NO: 1086 - protein, 9 aa, BORRELIA OppA
SAIKNGQKY

SEQ ID NO: 1087 - protein, 9 aa, BORRELIA OppA
YVFEKNDKY

SEQ ID NO: 1088 - protein, 9 aa, BORRELIA OppA
SVIKNGQKY

SEQ ID NO: 1089 - protein, 9 aa, BORRELIA OppA
YVFEKNNKY

SEQ ID NO: 1090 - protein, 9 aa, BORRELIA OppA
EANKKICEF

SEQ ID NO: 1091 - protein, 9 aa, BORRELIA OppA
IVAERNPRY

SEQ ID NO: 1092 - protein, 9 aa, BORRELIA OppA
TVINKVTYL

SEQ ID NO: 1093 - protein, 9 aa, BORRELIA OppA
DVSPQLATY

SEQ ID NO: 1094 - protein, 9 aa, BORRELIA OppA
DAATFLNNF

SEQ ID NO: 1095 - protein, 9 aa, BORRELIA OppA
TTQERGQFY

SEQ ID NO: 1096 - protein, 9 aa, BORRELIA OppA
LVKPWVGGF

SEQ ID NO: 1097 - protein, 9 aa, BORRELIA OppA
FTPDKLGYY

SEQ ID NO: 1098 - protein, 10 aa, BORRELIA OppA
STIKNGQKYF

SEQ ID NO: 1099 - protein, 10 aa, BORRELIA OppA
YVVEKNDKYY

SEQ ID NO: 1100 - protein, 10 aa, BORRELIA OppA
QVEVQEITFY

SEQ ID NO: 1101 - protein, 10 aa, BORRELIA OppA
YTTNDNSTAY

SEQ ID NO: 1102 - protein, 10 aa, BORRELIA OppA
ITPNFSSYSY

SEQ ID NO: 1103 - protein, 10 aa, BORRELIA OppA
ELENEEWTTY

SEQ ID NO: 1104 - protein, 10 aa, BORRELIA OppA
YTTNDSSTAY

SEQ ID NO: 1105 - protein, 10 aa, BORRELIA OppA
EVEVQEITFY

SEQ ID NO: 1106 - protein, 10 aa, BORRELIA OppA
ATPNFSSYSY

SEQ ID NO: 1107 - protein, 10 aa, BORRELIA OppA
YVFEKNDKYY

SEQ ID NO: 1108 - protein, 10 aa, BORRELIA OppA
EVEVQEIAFY

SEQ ID NO: 1109 - protein, 10 aa, BORRELIA OppA
SVIKNGQKYF

SEQ ID NO: 1110 - protein, 10 aa, BORRELIA OppA
YVFEKNNKYY

SEQ ID NO: 1111 - protein, 10 aa, BORRELIA OppA
EVELEEITFY

SEQ ID NO: 1112 - protein, 10 aa, BORRELIA OppA
DVSPQLATYY

SEQ ID NO: 1113 - protein, 10 aa, BORRELIA OppA
HTHNFDAVRY

SEQ ID NO: 1114 - protein, 10 aa, BORRELIA OppA
DVPAIPVYHY

SEQ ID NO: 1115 - protein, 10 aa, BORRELIA OppA
HLVKPWVGGF

SEQ ID NO: 1116 - protein, 10 aa, BORRELIA OppA
GFTPDKLGYY

SEQ ID NO: 1117 - protein, 10 aa, BORRELIA OppA
FTPDKLGYYY

SEQ ID NO: 1118 - protein, 11 aa, BORRELIA OppA
EIARAGWIGDY

SEQ ID NO: 1119 - protein, 11 aa, BORRELIA OppA
NEVEVQEITFY

SEQ ID NO: 1120 - protein, 11 aa, BORRELIA OppA
EVEVQEITFYT

SEQ ID NO: 1121 - protein, 11 aa, BORRELIA OppA
SEVEVQEIAFY

SEQ ID NO: 1122 - protein, 11 aa, BORRELIA OppA
EVEVQEIAFYT

SEQ ID NO: 1123 - protein, 11 aa, BORRELIA OppA
EIARAGWIGDY

SEQ ID NO: 1124 - protein, 11 aa, BORRELIA OppA
EVELEEITFYT

SEQ ID NO: 1125 - protein, 11 aa, BORRELIA OppA
DPKTASPYASY

SEQ ID NO: 1126 - protein, 11 aa, BORRELIA OppA
ERIVAERNPRY

SEQ ID NO: 1127 - protein, 11 aa, BORRELIA OppA
GGFTPDKLGYY

SEQ ID NO: 1128 - protein, 11 aa, BORRELIA OppA
GFTPDKLGYYY

SEQ ID NO: 1129 - protein, 11 aa, BORRELIA OppA
FTPDKLGYYYT

SEQ ID NO: 1130 - protein, 12 aa, BORRELIA OppA
EIAKTLLAEAGY

SEQ ID NO: 1131 - protein, 12 aa, BORRELIA OppA
YEIARAGWIGDY

SEQ ID NO: 1132 - protein, 12 aa, BORRELIA OppA
EIARAGWIGDYA

SEQ ID NO: 1133 - protein, 12 aa, BORRELIA OppA
SNEVEVQEITFY

SEQ ID NO: 1134 - protein, 12 aa, BORRELIA OppA
NEVEVQEITFYT

SEQ ID NO: 1135 - protein, 12 aa, BORRELIA OppA
EVEVQEITFYTT

SEQ ID NO: 1136 - protein, 12 aa, BORRELIA OppA
SSEVEVQEIAFY

SEQ ID NO: 1137 - protein, 12 aa, BORRELIA OppA
SEVEVQEIAFYT

SEQ ID NO: 1138 - protein, 12 aa, BORRELIA OppA
EVEVQEIAFYTT

SEQ ID NO: 1139 - protein, 12 aa, BORRELIA OppA
EVELEEITFYTT

SEQ ID NO: 1140 - protein, 12 aa, BORRELIA OppA
DPKTASPYASYP

SEQ ID NO: 1141 - protein, 12 aa, BORRELIA OppA
ERIVAERNPRYW

SEQ ID NO: 1142 - protein, 12 aa, BORRELIA OppA
GGFTPDKLGYYY

SEQ ID NO: 1143 - protein, 12 aa, BORRELIA OppA
GFTPDKLGYYYT

SEQ ID NO: 1144 - protein, 12 aa, BORRELIA OppA
FTPDKLGYYYTK

SEQ ID NO: 1145 - protein, 9 aa, BORRELIA OppA
FLIIFFLTF

SEQ ID NO: 1146 - protein, 9 aa, BORRELIA OppA
STIKNGQKY

SEQ ID NO: 1147 - protein, 9 aa, BORRELIA OppA
ITLESPKPY

SEQ ID NO: 1148 - protein, 9 aa, BORRELIA OppA
YFIDMLVHQ

SEQ ID NO: 1149 - protein, 9 aa, BORRELIA OppA
IPIHIAEKY

SEQ ID NO: 1150 - protein, 9 aa, BORRELIA OppA
YVVEKNDKY

SEQ ID NO: 1151 - protein, 9 aa, BORRELIA OppA
TTNDNSTAY

SEQ ID NO: 1152 - protein, 9 aa, BORRELIA OppA
YSSAVNAIY

SEQ ID NO: 1153 - protein, 9 aa, BORRELIA OppA
SAVNAIYFY

SEQ ID NO: 1154 - protein, 9 aa, BORRELIA OppA
VNAIYFYAF

SEQ ID NO: 1155 - protein, 9 aa, BORRELIA OppA
YFYAFNTHI

SEQ ID NO: 1156 - protein, 9 aa, BORRELIA OppA
RITPNFSSY

SEQ ID NO: 1157 - protein, 9 aa, BORRELIA OppA
TPNFSSYSY

SEQ ID NO: 1158 - protein, 9 aa, BORRELIA OppA
KTLLAEAGY

SEQ ID NO: 1159 - protein, 9 aa, BORRELIA OppA
GFPILKLKY

SEQ ID NO: 1160 - protein, 9 aa, BORRELIA OppA
FLSIFTQGY

SEQ ID NO: 1161 - protein, 9 aa, BORRELIA OppA
IFTQGYTQF

SEQ ID NO: 1162 - protein, 9 aa, BORRELIA OppA
YTQFSSHNY

SEQ ID NO: 1163 - protein, 9 aa, BORRELIA OppA
SHNYSSPEY

SEQ ID NO: 1164 - protein, 9 aa, BORRELIA OppA
KDFPIAPIY

SEQ ID NO: 1165 - protein, 9 aa, BORRELIA OppA
FPIAPIYIY

SEQ ID NO: 1166 - protein, 9 aa, BORRELIA OppA
PIYIYGNSY

SEQ ID NO: 1167 - protein, 9 aa, BORRELIA OppA
YIYGNSYLF

SEQ ID NO: 1168 - protein, 9 aa, BORRELIA OppA
FLSILTHGY

SEQ ID NO: 1169 - protein, 9 aa, BORRELIA OppA
ILTHGYTQF

SEQ ID NO: 1170 - protein, 9 aa, BORRELIA OppA
FLSIFTHGY

SEQ ID NO: 1171 - protein, 9 aa, BORRELIA OppA
IFTHGYTQF

SEQ ID NO: 1172 - protein, 9 aa, BORRELIA OppA
FSVIFFLTF

SEQ ID NO: 1173 - protein, 9 aa, BORRELIA OppA
TTNDSSTAY

SEQ ID NO: 1174 - protein, 9 aa, BORRELIA OppA
IYFYAFNTY

SEQ ID NO: 1175 - protein, 9 aa, BORRELIA OppA
YFYAFNTYI

SEQ ID NO: 1176 - protein, 9 aa, BORRELIA OppA
RIAPNFSSY

SEQ ID NO: 1177 - protein, 9 aa, BORRELIA OppA
APNFSSYSY

SEQ ID NO: 1178 - protein, 9 aa, BORRELIA OppA
NISPDGTVY

SEQ ID NO: 1179 - protein, 9 aa, BORRELIA OppA
YFYAFNTTV

SEQ ID NO: 1180 - protein, 9 aa, BORRELIA OppA
RATPNFSSY

SEQ ID NO: 1181 - protein, 9 aa, BORRELIA OppA
SHNYSNSEY

SEQ ID NO: 1182 - protein, 9 aa, BORRELIA OppA
SLLFLIIFF

SEQ ID NO: 1183 - protein, 9 aa, BORRELIA OppA
YVFEKNDKY

SEQ ID NO: 1184 - protein, 9 aa, BORRELIA OppA
VFEKNDKYY

SEQ ID NO: 1185 - protein, 9 aa, BORRELIA OppA
YFYAFNTKV

SEQ ID NO: 1186 - protein, 9 aa, BORRELIA OppA
SVIKNGQKY

SEQ ID NO: 1187 - protein, 9 aa, BORRELIA OppA
YVFEKNNKY

SEQ ID NO: 1188 - protein, 9 aa, BORRELIA OppA
VFEKNNKYY

SEQ ID NO: 1189 - protein, 9 aa, BORRELIA OppA
SHNYSNPEY

SEQ ID NO: 1190 - protein, 9 aa, BORRELIA OppA
KTASPYASY

SEQ ID NO: 1191 - protein, 9 aa, BORRELIA OppA
IVAERNPRY

SEQ ID NO: 1192 - protein, 9 aa, BORRELIA OppA
HTVINKVTY

SEQ ID NO: 1193 - protein, 9 aa, BORRELIA OppA
DVSPQLATY

SEQ ID NO: 1194 - protein, 9 aa, BORRELIA OppA
VSPQLATYY

SEQ ID NO: 1195 - protein, 9 aa, BORRELIA OppA
SPQLATYYY

SEQ ID NO: 1196 - protein, 9 aa, BORRELIA OppA
QLATYYYEF

SEQ ID NO: 1197 - protein, 9 aa, BORRELIA OppA
GVTLKTPDY

SEQ ID NO: 1198 - protein, 9 aa, BORRELIA OppA
FNASHPLSF

SEQ ID NO: 1199 - protein, 9 aa, BORRELIA OppA
HPLSFNLLY

SEQ ID NO: 1200 - protein, 9 aa, BORRELIA OppA
TMLDTMHTH

SEQ ID NO: 1201 - protein, 9 aa, BORRELIA OppA
THNFDAVRY

SEQ ID NO: 1202 - protein, 9 aa, BORRELIA OppA
VRYAWIADY

SEQ ID NO: 1203 - protein, 9 aa, BORRELIA OppA
TSQYSNPDY

SEQ ID NO: 1204 - protein, 9 aa, BORRELIA OppA
TTQERGQFY

SEQ ID NO: 1205 - protein, 9 aa, BORRELIA OppA
VPAIPVYHY

SEQ ID NO: 1206 - protein, 9 aa, BORRELIA OppA
GFTPDKLGY

SEQ ID NO: 1207 - protein, 9 aa, BORRELIA OppA
FTPDKLGYY

SEQ ID NO: 1208 - protein, 9 aa, BORRELIA OppA
TPDKLGYYY

SEQ ID NO: 1209 - protein, 9 aa, BORRELIA OppA
GYYYTKDMY

SEQ ID NO: 1210 - protein, 9 aa, BORRELIA OppA
YYYTKDMYI

SEQ ID NO: 1211 - protein, 10 aa, BORRELIA OppA
LFLIIFFLTF

SEQ ID NO: 1212 - protein, 10 aa, BORRELIA OppA
WDISPDGTVY

SEQ ID NO: 1213 - protein, 10 aa, BORRELIA OppA
YVVEKNDKYY

SEQ ID NO: 1214 - protein, 10 aa, BORRELIA OppA
YTTNDNSTAY

SEQ ID NO: 1215 - protein, 10 aa, BORRELIA OppA
YYSSAVNAIY

SEQ ID NO: 1216 - protein, 10 aa, BORRELIA OppA
YSSAVNAIYF

SEQ ID NO: 1217 - protein, 10 aa, BORRELIA OppA
SSAVNAIYFY

SEQ ID NO: 1218 - protein, 10 aa, BORRELIA OppA
AVNAIYFYAF

SEQ ID NO: 1219 - protein, 10 aa, BORRELIA OppA
LAIDRETLTY

SEQ ID NO: 1220 - protein, 10 aa, BORRELIA OppA
ITPNFSSYSY

SEQ ID NO: 1221 - protein, 10 aa, BORRELIA OppA
YSYAKNLELF

SEQ ID NO: 1222 - protein, 10 aa, BORRELIA OppA
NGFPILKLKY

SEQ ID NO: 1223 - protein, 10 aa, BORRELIA OppA
YLNTKSNGNY

SEQ ID NO: 1224 - protein, 10 aa, BORRELIA OppA
IARAGWIGDY

SEQ ID NO: 1225 - protein, 10 aa, BORRELIA OppA
TFLSIFTQGY

SEQ ID NO: 1226 - protein, 10 aa, BORRELIA OppA
FLSIFTQGYT

SEQ ID NO: 1227 - protein, 10 aa, BORRELIA OppA
SIFTQGYTQF

SEQ ID NO: 1228 - protein, 10 aa, BORRELIA OppA
GYTQFSSHNY

SEQ ID NO: 1229 - protein, 10 aa, BORRELIA OppA
YTQFSSHNYS

SEQ ID NO: 1230 - protein, 10 aa, BORRELIA OppA
SSHNYSSPEY

SEQ ID NO: 1231 - protein, 10 aa, BORRELIA OppA
DFPIAPIYIY

SEQ ID NO: 1232 - protein, 10 aa, BORRELIA OppA
APIYIYGNSY

SEQ ID NO: 1233 - protein, 10 aa, BORRELIA OppA
IYIYGNSYLF

SEQ ID NO: 1234 - protein, 10 aa, BORRELIA OppA
YIYGNSYLFR

SEQ ID NO: 1235 - protein, 10 aa, BORRELIA OppA
TFLSILTHGY

SEQ ID NO: 1236 - protein, 10 aa, BORRELIA OppA
FLSILTHGYT

SEQ ID NO: 1237 - protein, 10 aa, BORRELIA OppA
TFLSIFTHGY

SEQ ID NO: 1238 - protein, 10 aa, BORRELIA OppA
FLSIFTHGYT

SEQ ID NO: 1239 - protein, 10 aa, BORRELIA OppA
SIFTHGYTQF

SEQ ID NO: 1240 - protein, 10 aa, BORRELIA OppA
LFSVIFFLTF

SEQ ID NO: 1241 - protein, 10 aa, BORRELIA OppA
YTTNDSSTAY

SEQ ID NO: 1242 - protein, 10 aa, BORRELIA OppA
NDSSTAYKMY

SEQ ID NO: 1243 - protein, 10 aa, BORRELIA OppA
AIYFYAFNTY

SEQ ID NO: 1244 - protein, 10 aa, BORRELIA OppA
IYFYAFNTYI

SEQ ID NO: 1245 - protein, 10 aa, BORRELIA OppA
YFYAFNTYIK

SEQ ID NO: 1246 - protein, 10 aa, BORRELIA OppA
RRIAPNFSSY

SEQ ID NO: 1247 - protein, 10 aa, BORRELIA OppA
IAPNFSSYSY

SEQ ID NO: 1248 - protein, 10 aa, BORRELIA OppA
YLNTRSNGNY

SEQ ID NO: 1249 - protein, 10 aa, BORRELIA OppA
WNISPDGTVY

SEQ ID NO: 1250 - protein, 10 aa, BORRELIA OppA
ATPNFSSYSY

SEQ ID NO: 1251 - protein, 10 aa, BORRELIA OppA
WDISSDGTVY

SEQ ID NO: 1252 - protein, 10 aa, BORRELIA OppA
KYVFEKNDKY

SEQ ID NO: 1253 - protein, 10 aa, BORRELIA OppA
YVFEKNDKYY

SEQ ID NO: 1254 - protein, 10 aa, BORRELIA OppA
LAIDRETLAY

SEQ ID NO: 1255 - protein, 10 aa, BORRELIA OppA
YLNTKANGNY

SEQ ID NO: 1256 - protein, 10 aa, BORRELIA OppA
KYVFEKNNKY

SEQ ID NO: 1257 - protein, 10 aa, BORRELIA OppA
YVFEKNNKYY

SEQ ID NO: 1258 - protein, 10 aa, BORRELIA OppA
YSYAKSLELF

SEQ ID NO: 1259 - protein, 10 aa, BORRELIA OppA
SSHNYSNPEY

SEQ ID NO: 1260 - protein, 10 aa, BORRELIA OppA
LDVSPQLATY

SEQ ID NO: 1261 - protein, 10 aa, BORRELIA OppA
DVSPQLATYY

SEQ ID NO: 1262 - protein, 10 aa, BORRELIA OppA
VSPQLATYYY

SEQ ID NO: 1263 - protein, 10 aa, BORRELIA OppA
PQLATYYYEF

SEQ ID NO: 1264 - protein, 10 aa, BORRELIA OppA
YEFNTTRPPF

SEQ ID NO: 1265 - protein, 10 aa, BORRELIA OppA
GFNASHPLSF

SEQ ID NO: 1266 - protein, 10 aa, BORRELIA OppA
SHPLSFNLLY

SEQ ID NO: 1267 - protein, 10 aa, BORRELIA OppA
HTHNFDAVRY

SEQ ID NO: 1268 - protein, 10 aa, BORRELIA OppA
AVRYAWIADY

SEQ ID NO: 1269 - protein, 10 aa, BORRELIA OppA
NTSQYSNPDY

SEQ ID NO: 1270 - protein, 10 aa, BORRELIA OppA
DVPAIPVYHY

SEQ ID NO: 1271 - protein, 10 aa, BORRELIA OppA
GGFTPDKLGY

SEQ ID NO: 1272 - protein, 10 aa, BORRELIA OppA
GFTPDKLGYY

SEQ ID NO: 1273 - protein, 10 aa, BORRELIA OppA
FTPDKLGYYY

SEQ ID NO: 1274 - protein, 10 aa, BORRELIA OppA
LGYYYTKDMY

SEQ ID NO: 1275 - protein, 10 aa, BORRELIA OppA
GYYYTKDMYI

SEQ ID NO: 1276 - protein, 11 aa, BORRELIA OppA
LLFLIIFFLTF

SEQ ID NO: 1277 - protein, 11 aa, BORRELIA OppA
YFIDMLVHQSF

SEQ ID NO: 1278 - protein, 11 aa, BORRELIA OppA
KYVVEKNDKYY

SEQ ID NO: 1279 - protein, 11 aa, BORRELIA OppA
FYTTNDNSTAY

SEQ ID NO: 1280 - protein, 11 aa, BORRELIA OppA
DYYSSAVNAIY

SEQ ID NO: 1281 - protein, 11 aa, BORRELIA OppA
YSSAVNAIYFY

SEQ ID NO: 1282 - protein, 11 aa, BORRELIA OppA
RITPNFSSYSY

SEQ ID NO: 1283 - protein, 11 aa, BORRELIA OppA
LTFLSIFTQGY

SEQ ID NO: 1284 - protein, 11 aa, BORRELIA OppA
TFLSIFTQGYT

SEQ ID NO: 1285 - protein, 11 aa, BORRELIA OppA
QGYTQFSSHNY

SEQ ID NO: 1286 - protein, 11 aa, BORRELIA OppA
PIYIYGNSYLF

SEQ ID NO: 1287 - protein, 11 aa, BORRELIA OppA
IYIYGNSYLFR

SEQ ID NO: 1288 - protein, 11 aa, BORRELIA OppA
YIYGNSYLFRN

SEQ ID NO: 1289 - protein, 11 aa, BORRELIA OppA
LTFLSILTHGY

SEQ ID NO: 1290 - protein, 11 aa, BORRELIA OppA
HGYTQFSSHNY

SEQ ID NO: 1291 - protein, 11 aa, BORRELIA OppA
LTFLSIFTHGY

SEQ ID NO: 1292 - protein, 11 aa, BORRELIA OppA
TFLSIFTHGYT

SEQ ID NO: 1293 - protein, 11 aa, BORRELIA OppA
LLFSVIFFLTF

SEQ ID NO: 1294 - protein, 11 aa, BORRELIA OppA
FYTTNDSSTAY

SEQ ID NO: 1295 - protein, 11 aa, BORRELIA OppA
NAIYFYAFNTY

SEQ ID NO: 1296 - protein, 11 aa, BORRELIA OppA
AIYFYAFNTYI

SEQ ID NO: 1297 - protein, 11 aa, BORRELIA OppA
RIAPNFSSYSY

SEQ ID NO: 1298 - protein, 11 aa, BORRELIA OppA
SLFLIIFFLTF

SEQ ID NO: 1299 - protein, 11 aa, BORRELIA OppA
ATFLSIFTQGY

SEQ ID NO: 1300 - protein, 11 aa, BORRELIA OppA
KYVFEKNDKYY

SEQ ID NO: 1301 - protein, 11 aa, BORRELIA OppA
YVFEKNDKYYN

SEQ ID NO: 1302 - protein, 11 aa, BORRELIA OppA
TLAIDRETLAY

SEQ ID NO: 1303 - protein, 11 aa, BORRELIA OppA
KYVFEKNNKYY

SEQ ID NO: 1304 - protein, 11 aa, BORRELIA OppA
SYSYAKSLELF

SEQ ID NO: 1305 - protein, 11 aa, BORRELIA OppA
DVSPQLATYYY

SEQ ID NO: 1306 - protein, 11 aa, BORRELIA OppA
ASHPLSFNLLY

SEQ ID NO: 1307 - protein, 11 aa, BORRELIA OppA
DAVRYAWIADY

SEQ ID NO: 1308 - protein, 11 aa, BORRELIA OppA
GGFTPDKLGYY

SEQ ID NO: 1309 - protein, 11 aa, BORRELIA OppA
GFTPDKLGYYY

SEQ ID NO: 1310 - protein, 11 aa, BORRELIA OppA
KLGYYYTKDMY

SEQ ID NO: 1311 - protein, 12 aa, BORRELIA OppA
KLLFLIIFFLTF

SEQ ID NO: 1312 - protein, 12 aa, BORRELIA OppA
PYFIDMLVHQSF

SEQ ID NO: 1313 - protein, 12 aa, BORRELIA OppA
EKYVVEKNDKYY

SEQ ID NO: 1314 - protein, 12 aa, BORRELIA OppA
TFYTTNDNSTAY

SEQ ID NO: 1315 - protein, 12 aa, BORRELIA OppA
SDYYSSAVNAIY

SEQ ID NO: 1316 - protein, 12 aa, BORRELIA OppA
YYSSAVNAIYFY

SEQ ID NO: 1317 - protein, 12 aa, BORRELIA OppA
YSSAVNAIYFYA

SEQ ID NO: 1318 - protein, 12 aa, BORRELIA OppA
LTLAIDRETLTY

SEQ ID NO: 1319 - protein, 12 aa, BORRELIA OppA
RRITPNFSSYSY

SEQ ID NO: 1320 - protein, 12 aa, BORRELIA OppA
PLTFLSIFTQGY

SEQ ID NO: 1321 - protein, 12 aa, BORRELIA OppA
LTFLSIFTQGYT

SEQ ID NO: 1322 - protein, 12 aa, BORRELIA OppA
TQGYTQFSSHNY

SEQ ID NO: 1323 - protein, 12 aa, BORRELIA OppA
QFSSHNYSSPEY

SEQ ID NO: 1324 - protein, 12 aa, BORRELIA OppA
IIEKDFPIAPIY

SEQ ID NO: 1325 - protein, 12 aa, BORRELIA OppA
APIYIYGNSYLF

SEQ ID NO: 1326 - protein, 12 aa, BORRELIA OppA
PIYIYGNSYLFR

SEQ ID NO: 1327 - protein, 12 aa, BORRELIA OppA
IYIYGNSYLFRN

SEQ ID NO: 1328 - protein, 12 aa, BORRELIA OppA
YIYGNSYLFRND

SEQ ID NO: 1329 - protein, 12 aa, BORRELIA OppA
PLTFLSILTHGY

SEQ ID NO: 1330 - protein, 12 aa, BORRELIA OppA
THGYTQFSSHNY

SEQ ID NO: 1331 - protein, 12 aa, BORRELIA OppA
PLTFLSIFTHGY

SEQ ID NO: 1332 - protein, 12 aa, BORRELIA OppA
LTFLSIFTHGYT

SEQ ID NO: 1333 - protein, 12 aa, BORRELIA OppA
KLLFSVIFFLTF

SEQ ID NO: 1334 - protein, 12 aa, BORRELIA OppA
TFYTTNDSSTAY

SEQ ID NO: 1335 - protein, 12 aa, BORRELIA OppA
VNAIYFYAFNTY

SEQ ID NO: 1336 - protein, 12 aa, BORRELIA OppA
NAIYFYAFNTYI

SEQ ID NO: 1337 - protein, 12 aa, BORRELIA OppA
AIYFYAFNTYIK

SEQ ID NO: 1338 - protein, 12 aa, BORRELIA OppA
RRIAPNFSSYSY

SEQ ID NO: 1339 - protein, 12 aa, BORRELIA OppA
KSLFLIIFFLTF

SEQ ID NO: 1340 - protein, 12 aa, BORRELIA OppA
NDYYSSAVNAIY

SEQ ID NO: 1341 - protein, 12 aa, BORRELIA OppA
PATFLSIFTQGY

SEQ ID NO: 1342 - protein, 12 aa, BORRELIA OppA
ATFLSIFTQGYT

SEQ ID NO: 1343 - protein, 12 aa, BORRELIA OppA
QFSSHNYSNSEY

SEQ ID NO: 1344 - protein, 12 aa, BORRELIA OppA
SLLFLIIFFLTF

SEQ ID NO: 1345 - protein, 12 aa, BORRELIA OppA
EKYVFEKNDKYY

SEQ ID NO: 1346 - protein, 12 aa, BORRELIA OppA
KYVFEKNDKYYN

SEQ ID NO: 1347 - protein, 12 aa, BORRELIA OppA
AFYTTNDSSTAY

SEQ ID NO: 1348 - protein, 12 aa, BORRELIA OppA
LTLAIDRETLAY

SEQ ID NO: 1349 - protein, 12 aa, BORRELIA OppA
RSLFLIIFFLTF

SEQ ID NO: 1350 - protein, 12 aa, BORRELIA OppA
EKYVFEKNNKYY

SEQ ID NO: 1351 - protein, 12 aa, BORRELIA OppA
QFSSHNYSNPEY

SEQ ID NO: 1352 - protein, 12 aa, BORRELIA OppA
LDVSPQLATYYY

SEQ ID NO: 1353 - protein, 12 aa, BORRELIA OppA
YYYEFNTTRPPF

SEQ ID NO: 1354 - protein, 12 aa, BORRELIA OppA
NASHPLSFNLLY

SEQ ID NO: 1355 - protein, 12 aa, BORRELIA OppA
TMHTHNFDAVRY

SEQ ID NO: 1356 - protein, 12 aa, BORRELIA OppA
FDAVRYAWIADY

SEQ ID NO: 1357 - protein, 12 aa, BORRELIA OppA
WVGGFTPDKLGY

SEQ ID NO: 1358 - protein, 12 aa, BORRELIA OppA
VGGFTPDKLGYY

SEQ ID NO: 1359 - protein, 12 aa, BORRELIA OppA
GGFTPDKLGYYY

SEQ ID NO: 1360 - protein, 12 aa, BORRELIA OppA
GFTPDKLGYYYT

SEQ ID NO: 1361 - protein, 12 aa, BORRELIA OppA
DKLGYYYTKDMY

SEQ ID NO: 1362 - protein, 9 aa, BORRELIA OppA
LLFLIIFFL

SEQ ID NO: 1363 - protein, 9 aa, BORRELIA OppA
GTVYTFTLR

SEQ ID NO: 1364 - protein, 9 aa, BORRELIA OppA
KSYLRILNK

SEQ ID NO: 1365 - protein, 9 aa, BORRELIA OppA
KSTIKNGQK

SEQ ID NO: 1366 - protein, 9 aa, BORRELIA OppA
AVNAIYFYA

SEQ ID NO: 1367 - protein, 9 aa, BORRELIA OppA
HIKPLDNVK

SEQ ID NO: 1368 - protein, 9 aa, BORRELIA OppA
KALTLAIDR

SEQ ID NO: 1369 - protein, 9 aa, BORRELIA OppA
NFSSYSYAK

SEQ ID NO: 1370 - protein, 9 aa, BORRELIA OppA
KYNTSEAHK

SEQ ID NO: 1371 - protein, 9 aa, BORRELIA OppA
PIKRQDILR

SEQ ID NO: 1372 - protein, 9 aa, BORRELIA OppA
IYGNSYLFR

SEQ ID NO: 1373 - protein, 9 aa, BORRELIA OppA
GWNTNITER

SEQ ID NO: 1374 - protein, 9 aa, BORRELIA OppA
LTFLSIFTH

SEQ ID NO: 1375 - protein, 9 aa, BORRELIA OppA
LLFSVIFFL

SEQ ID NO: 1376 - protein, 9 aa, BORRELIA OppA
YFYAFNTYI

SEQ ID NO: 1377 - protein, 9 aa, BORRELIA OppA
KSLFLIIFF

SEQ ID NO: 1378 - protein, 9 aa, BORRELIA OppA
SLFLIIFFL

SEQ ID NO: 1379 - protein, 9 aa, BORRELIA OppA
KAKEGVSFK

SEQ ID NO: 1380 - protein, 9 aa, BORRELIA OppA
KSAIKNGQK

SEQ ID NO: 1381 - protein, 9 aa, BORRELIA OppA
KYNTSDANK

SEQ ID NO: 1382 - protein, 9 aa, BORRELIA OppA
GWNTNISER

SEQ ID NO: 1383 - protein, 9 aa, BORRELIA OppA
IYFYAFNTK

SEQ ID NO: 1384 - protein, 9 aa, BORRELIA OppA
KVRPLDNVK

SEQ ID NO: 1385 - protein, 9 aa, BORRELIA OppA
RSLFLIIFF

SEQ ID NO: 1386 - protein, 9 aa, BORRELIA OppA
LTFLCCNNK

SEQ ID NO: 1387 - protein, 9 aa, BORRELIA OppA
GTVYTFNLR

SEQ ID NO: 1388 - protein, 9 aa, BORRELIA OppA
KSVIKNGQK

SEQ ID NO: 1389 - protein, 9 aa, BORRELIA OppA
KYVFEKNNK

SEQ ID NO: 1390 - protein, 9 aa, BORRELIA OppA
KYNTNEANK

SEQ ID NO: 1391 - protein, 9 aa, BORRELIA OppA
GWNTNILER

SEQ ID NO: 1392 - protein, 9 aa, BORRELIA OppA
RTNFTLSLL

SEQ ID NO: 1393 - protein, 9 aa, BORRELIA OppA
RLAEKWENK

SEQ ID NO: 1394 - protein, 9 aa, BORRELIA OppA
NTVWTFHLR

SEQ ID NO: 1395 - protein, 9 aa, BORRELIA OppA
HLVTSGAYK

SEQ ID NO: 1396 - protein, 9 aa, BORRELIA OppA
LSQWVVNER

SEQ ID NO: 1397 - protein, 9 aa, BORRELIA OppA
VNERIVAER

SEQ ID NO: 1398 - protein, 9 aa, BORRELIA OppA
RIVAERNPR

SEQ ID NO: 1399 - protein, 9 aa, BORRELIA OppA
YYYEFNTTR

SEQ ID NO: 1400 - protein, 9 aa, BORRELIA OppA
HTHNFDAVR

SEQ ID NO: 1401 - protein, 9 aa, BORRELIA OppA
AATFLNNFR

SEQ ID NO: 1402 - protein, 9 aa, BORRELIA OppA
AIPVYHYVR

SEQ ID NO: 1403 - protein, 9 aa, BORRELIA OppA
HYVRTHLVK

SEQ ID NO: 1404 - protein, 9 aa, BORRELIA OppA
YTKDMYIKK

SEQ ID NO: 1405 - protein, 10 aa, BORRELIA OppA
KLLFLIIFFL

SEQ ID NO: 1406 - protein, 10 aa, BORRELIA OppA
FFLTFLCCNK

SEQ ID NO: 1407 - protein, 10 aa, BORRELIA OppA
GSKMIDTMFK

SEQ ID NO: 1408 - protein, 10 aa, BORRELIA OppA
DGTVYTFTLR

SEQ ID NO: 1409 - protein, 10 aa, BORRELIA OppA
AEGIRKSYLR

SEQ ID NO: 1410 - protein, 10 aa, BORRELIA OppA
RKSYLRILNK

SEQ ID NO: 1411 - protein, 10 aa, BORRELIA OppA
TSGPFKLKER

SEQ ID NO: 1412 - protein, 10 aa, BORRELIA OppA
KLKERIPNEK

SEQ ID NO: 1413 - protein, 10 aa, BORRELIA OppA
TTNDNSTAYK

SEQ ID NO: 1414 - protein, 10 aa, BORRELIA OppA
AVNAIYFYAF

SEQ ID NO: 1415 - protein, 10 aa, BORRELIA OppA
YFYAFNTHIK

SEQ ID NO: 1416 - protein, 10 aa, BORRELIA OppA
RKALTLAIDR

SEQ ID NO: 1417 - protein, 10 aa, BORRELIA OppA
AIDRETLTYK

SEQ ID NO: 1418 - protein, 10 aa, BORRELIA OppA
KYNTSEAHKK

SEQ ID NO: 1419 - protein, 10 aa, BORRELIA OppA
KSNGNYEIAR

SEQ ID NO: 1420 - protein, 10 aa, BORRELIA OppA
YIYGNSYLFR

SEQ ID NO: 1421 - protein, 10 aa, BORRELIA OppA
TGWNTNITER

SEQ ID NO: 1422 - protein, 10 aa, BORRELIA OppA
RFDLSQLKLK

SEQ ID NO: 1423 - protein, 10 aa, BORRELIA OppA
KLLFSVIFFL

SEQ ID NO: 1424 - protein, 10 aa, BORRELIA OppA
GSKMIDTMFR

SEQ ID NO: 1425 - protein, 10 aa, BORRELIA OppA
TTNDSSTAYK

SEQ ID NO: 1426 - protein, 10 aa, BORRELIA OppA
STAYKMYENK

SEQ ID NO: 1427 - protein, 10 aa, BORRELIA OppA
YFYAFNTYIK

SEQ ID NO: 1428 - protein, 10 aa, BORRELIA OppA
RSNGNYEIAR

SEQ ID NO: 1429 - protein, 10 aa, BORRELIA OppA
KSLFLIIFFL

SEQ ID NO: 1430 - protein, 10 aa, BORRELIA OppA
FFLTFLCCSK

SEQ ID NO: 1431 - protein, 10 aa, BORRELIA OppA
ASKMIDTMFR

SEQ ID NO: 1432 - protein, 10 aa, BORRELIA OppA
YFYAFNTTVK

SEQ ID NO: 1433 - protein, 10 aa, BORRELIA OppA
KYNTSDANKK

SEQ ID NO: 1434 - protein, 10 aa, BORRELIA OppA
TGWNTNISER

SEQ ID NO: 1435 - protein, 10 aa, BORRELIA OppA
SLLFLIIFFL

SEQ ID NO: 1436 - protein, 10 aa, BORRELIA OppA
AIYFYAFNTK

SEQ ID NO: 1437 - protein, 10 aa, BORRELIA OppA
YFYAFNTKVR

SEQ ID NO: 1438 - protein, 10 aa, BORRELIA OppA
AIDRETLAYK

SEQ ID NO: 1439 - protein, 10 aa, BORRELIA OppA
KANGNYEIAR

SEQ ID NO: 1440 - protein, 10 aa, BORRELIA OppA
RSLFLIIFFL

SEQ ID NO: 1441 - protein, 10 aa, BORRELIA OppA
TFLCCNNKER

SEQ ID NO: 1442 - protein, 10 aa, BORRELIA OppA
DGTVYTFNLR

SEQ ID NO: 1443 - protein, 10 aa, BORRELIA OppA
TGWNTNILER

SEQ ID NO: 1444 - protein, 10 aa, BORRELIA OppA
DNTVWTFHLR

SEQ ID NO: 1445 - protein, 10 aa, BORRELIA OppA
NTVWTFHLRP

SEQ ID NO: 1446 - protein, 10 aa, BORRELIA OppA
AQDVVWSWQR

SEQ ID NO: 1447 - protein, 10 aa, BORRELIA OppA
KVLINRFGEK

SEQ ID NO: 1448 - protein, 10 aa, BORRELIA OppA
KLSQWVVNER

SEQ ID NO: 1449 - protein, 10 aa, BORRELIA OppA
VVNERIVAER

SEQ ID NO: 1450 - protein, 10 aa, BORRELIA OppA
ERIVAERNPR

SEQ ID NO: 1451 - protein, 10 aa, BORRELIA OppA
ITSEAADVNR

SEQ ID NO: 1452 - protein, 10 aa, BORRELIA OppA
TYYYEFNTTR

SEQ ID NO: 1453 - protein, 10 aa, BORRELIA OppA
YYYEFNTTRP

SEQ ID NO: 1454 - protein, 10 aa, BORRELIA OppA
TTRPPFNDVR

SEQ ID NO: 1455 - protein, 10 aa, BORRELIA OppA
LYNTSESHQR

SEQ ID NO: 1456 - protein, 10 aa, BORRELIA OppA
MHTHNFDAVR

SEQ ID NO: 1457 - protein, 10 aa, BORRELIA OppA
DAATFLNNFR

SEQ ID NO: 1458 - protein, 10 aa, BORRELIA OppA
AAKAKTTQER

SEQ ID NO: 1459 - protein, 10 aa, BORRELIA OppA
PAIPVYHYVR

SEQ ID NO: 1460 - protein, 10 aa, BORRELIA OppA
YYYTKDMYIK

SEQ ID NO: 1461 - protein, 11 aa, BORRELIA OppA
TAEGIRKSYLR

SEQ ID NO: 1462 - protein, 11 aa, BORRELIA OppA
TKSNGNYEIAR

SEQ ID NO: 1463 - protein, 11 aa, BORRELIA OppA
IYIYGNSYLFR

SEQ ID NO: 1464 - protein, 11 aa, BORRELIA OppA
VGSKMIDTMFR

SEQ ID NO: 1465 - protein, 11 aa, BORRELIA OppA
IYFYAFNTYIK

SEQ ID NO: 1466 - protein, 11 aa, BORRELIA OppA
TRSNGNYEIAR

SEQ ID NO: 1467 - protein, 11 aa, BORRELIA OppA
VASKMIDTMFR

SEQ ID NO: 1468 - protein, 11 aa, BORRELIA OppA
ASKMIDTMFRG

SEQ ID NO: 1469 - protein, 11 aa, BORRELIA OppA
SDGTVYTFTLR

SEQ ID NO: 1470 - protein, 11 aa, BORRELIA OppA
IYFYAFNTKVR

SEQ ID NO: 1471 - protein, 11 aa, BORRELIA OppA
KVRPLDNVKVR

SEQ ID NO: 1472 - protein, 11 aa, BORRELIA OppA
TKANGNYEIAR

SEQ ID NO: 1473 - protein, 11 aa, BORRELIA OppA
LTFLCCNNKER

SEQ ID NO: 1474 - protein, 11 aa, BORRELIA OppA
SDGTVYTFNLR

SEQ ID NO: 1475 - protein, 11 aa, BORRELIA OppA
KDNTVWTFHLR

SEQ ID NO: 1476 - protein, 11 aa, BORRELIA OppA
YKLSQWVVNER

SEQ ID NO: 1477 - protein, 11 aa, BORRELIA OppA
WVVNERIVAER

SEQ ID NO: 1478 - protein, 11 aa, BORRELIA OppA
ATYYYEFNTTR

SEQ ID NO: 1479 - protein, 11 aa, BORRELIA OppA
NTTRPPFNDVR

SEQ ID NO: 1480 - protein, 11 aa, BORRELIA OppA
RPPFNDVRVRK

SEQ ID NO: 1481 - protein, 11 aa, BORRELIA OppA
LLYNTSESHQR

SEQ ID NO: 1482 - protein, 11 aa, BORRELIA OppA
TMHTHNFDAVR

SEQ ID NO: 1483 - protein, 12 aa, BORRELIA OppA
SPDGTVYTFTLR

SEQ ID NO: 1484 - protein, 12 aa, BORRELIA OppA
ITAEGIRKSYLR

SEQ ID NO: 1485 - protein, 12 aa, BORRELIA OppA
KVRKALTLAIDR

SEQ ID NO: 1486 - protein, 12 aa, BORRELIA OppA
KVLDDGTTPTRR

SEQ ID NO: 1487 - protein, 12 aa, BORRELIA OppA
NTKSNGNYEIAR

SEQ ID NO: 1488 - protein, 12 aa, BORRELIA OppA
PIYIYGNSYLFR

SEQ ID NO: 1489 - protein, 12 aa, BORRELIA OppA
KWTGWNTNITER

SEQ ID NO: 1490 - protein, 12 aa, BORRELIA OppA
NVGSKMIDTMFR

SEQ ID NO: 1491 - protein, 12 aa, BORRELIA OppA
AIYFYAFNTYIK

SEQ ID NO: 1492 - protein, 12 aa, BORRELIA OppA
KVLDNGTTPTRR

SEQ ID NO: 1493 - protein, 12 aa, BORRELIA OppA
NTRSNGNYEIAR

SEQ ID NO: 1494 - protein, 12 aa, BORRELIA OppA
TRSNGNYEIARA

SEQ ID NO: 1495 - protein, 12 aa, BORRELIA OppA
NVASKMIDTMFR

SEQ ID NO: 1496 - protein, 12 aa, BORRELIA OppA
VASKMIDTMFRG

SEQ ID NO: 1497 - protein, 12 aa, BORRELIA OppA
MVTSGPFKLKER

SEQ ID NO: 1498 - protein, 12 aa, BORRELIA OppA
KWTGWNTNISER

SEQ ID NO: 1499 - protein, 12 aa, BORRELIA OppA
SSDGTVYTFTLR

SEQ ID NO: 1500 - protein, 12 aa, BORRELIA OppA
AIYFYAFNTKVR

SEQ ID NO: 1501 - protein, 12 aa, BORRELIA OppA
TKVRPLDNVKVR

SEQ ID NO: 1502 - protein, 12 aa, BORRELIA OppA
KVRPLDNVKVRK

SEQ ID NO: 1503 - protein, 12 aa, BORRELIA OppA
NTKANGNYEIAR

SEQ ID NO: 1504 - protein, 12 aa, BORRELIA OppA
FLTFLCCNNKER

SEQ ID NO: 1505 - protein, 12 aa, BORRELIA OppA
SSDGTVYTFNLR

SEQ ID NO: 1506 - protein, 12 aa, BORRELIA OppA
KIRKALTLAIDR

SEQ ID NO: 1507 - protein, 12 aa, BORRELIA OppA
KSLELFNPEIAK

SEQ ID NO: 1508 - protein, 12 aa, BORRELIA OppA
KWTGWNTNILER

SEQ ID NO: 1509 - protein, 12 aa, BORRELIA OppA
NKDNTVWTFHLR

SEQ ID NO: 1510 - protein, 12 aa, BORRELIA OppA
KDNTVWTFHLRP

SEQ ID NO: 1511 - protein, 12 aa, BORRELIA OppA
ITAQDVVWSWQR

SEQ ID NO: 1512 - protein, 12 aa, BORRELIA OppA
SMVPVDKVLINR

SEQ ID NO: 1513 - protein, 12 aa, BORRELIA OppA
AYKLSQWVVNER

SEQ ID NO: 1514 - protein, 12 aa, BORRELIA OppA
QWVVNERIVAER

SEQ ID NO: 1515 - protein, 12 aa, BORRELIA OppA
RYWDNAHTVINK

SEQ ID NO: 1516 - protein, 12 aa, BORRELIA OppA
LATYYYEFNTTR

SEQ ID NO: 1517 - protein, 12 aa, BORRELIA OppA
ATYYYEFNTTRP

SEQ ID NO: 1518 - protein, 12 aa, BORRELIA OppA
FNTTRPPFNDVR

SEQ ID NO: 1519 - protein, 12 aa, BORRELIA OppA
TTRPPFNDVRVR

SEQ ID NO: 1520 - protein, 12 aa, BORRELIA OppA
TRPPFNDVRVRK

SEQ ID NO: 1521 - protein, 12 aa, BORRELIA OppA
NLLYNTSESHQR

SEQ ID NO: 1522 - protein, 12 aa, BORRELIA OppA
DTMHTHNFDAVR

SEQ ID NO: 1523 - protein, 9 aa, BORRELIA OppA
KLQKLLFLI

SEQ ID NO: 1524 - protein, 9 aa, BORRELIA OppA
KLLFLIIFF

SEQ ID NO: 1525 - protein, 9 aa, BORRELIA OppA
FLIIFFLTF

SEQ ID NO: 1526 - protein, 9 aa, BORRELIA OppA
IIFFLTFLC

SEQ ID NO: 1527 - protein, 9 aa, BORRELIA OppA
IIWSDGVAI

SEQ ID NO: 1528 - protein, 9 aa, BORRELIA OppA
KTLEITLES

SEQ ID NO: 1529 - protein, 9 aa, BORRELIA OppA
IDMLVHQSF

SEQ ID NO: 1530 - protein, 9 aa, BORRELIA OppA
LVHQSFIPI

SEQ ID NO: 1531 - protein, 9 aa, BORRELIA OppA
HQSFIPIPI

SEQ ID NO: 1532 - protein, 9 aa, BORRELIA OppA
VNAIYFYAF

SEQ ID NO: 1533 - protein, 9 aa, BORRELIA OppA
KILNIDVEL

SEQ ID NO: 1534 - protein, 9 aa, BORRELIA OppA
IIIEKDFPI

SEQ ID NO: 1535 - protein, 9 aa, BORRELIA OppA
YIYGNSYLF

SEQ ID NO: 1536 - protein, 9 aa, BORRELIA OppA
KLQKLLFSV

SEQ ID NO: 1537 - protein, 9 aa, BORRELIA OppA
QKLLFSVIF

SEQ ID NO: 1538 - protein, 9 aa, BORRELIA OppA
KLLFSVIFF

SEQ ID NO: 1539 - protein, 9 aa, BORRELIA OppA
KKEGISFKI

SEQ ID NO: 1540 - protein, 9 aa, BORRELIA OppA
KLQKSLFLI

SEQ ID NO: 1541 - protein, 9 aa, BORRELIA OppA
KSLFLIIFF

SEQ ID NO: 1542 - protein, 9 aa, BORRELIA OppA
ITWSDGVAI

SEQ ID NO: 1543 - protein, 9 aa, BORRELIA OppA
ELDAIFVSI

SEQ ID NO: 1544 - protein, 9 aa, BORRELIA OppA
KNLNIDVEL

SEQ ID NO: 1545 - protein, 9 aa, BORRELIA OppA
KSLLFLIIF

SEQ ID NO: 1546 - protein, 9 aa, BORRELIA OppA
SLLFLIIFF

SEQ ID NO: 1547 - protein, 9 aa, BORRELIA OppA
SSDGTVYTF

SEQ ID NO: 1548 - protein, 9 aa, BORRELIA OppA
ITWSDGVPI

SEQ ID NO: 1549 - protein, 9 aa, BORRELIA OppA
RIPNEKYVF

SEQ ID NO: 1550 - protein, 9 aa, BORRELIA OppA
KLQRSLFLI

SEQ ID NO: 1551 - protein, 9 aa, BORRELIA OppA
RSLFLIIFF

SEQ ID NO: 1552 - protein, 9 aa, BORRELIA OppA
YTFNLREKI

SEQ ID NO: 1553 - protein, 9 aa, BORRELIA OppA
HQSFIPVPV

SEQ ID NO: 1554 - protein, 9 aa, BORRELIA OppA
KSLELFNPE

SEQ ID NO: 1555 - protein, 9 aa, BORRELIA OppA
RTNFTLSLL

SEQ ID NO: 1556 - protein, 9 aa, BORRELIA OppA
TAQDVVWSW

SEQ ID NO: 1557 - protein, 9 aa, BORRELIA OppA
KTASPYASY

SEQ ID NO: 1558 - protein, 9 aa, BORRELIA OppA
SQWVVNERI

SEQ ID NO: 1559 - protein, 9 aa, BORRELIA OppA
IDIVYTVPI

SEQ ID NO: 1560 - protein, 9 aa, BORRELIA OppA
KTMGTQLDV

SEQ ID NO: 1561 - protein, 9 aa, BORRELIA OppA
QLATYYYEF

SEQ ID NO: 1562 - protein, 9 aa, BORRELIA OppA
SMWKKNLGV

SEQ ID NO: 1563 - protein, 10 aa, BORRELIA OppA
MLVHQSFIPI

SEQ ID NO: 1564 - protein, 10 aa, BORRELIA OppA
AVNAIYFYAF

SEQ ID NO: 1565 - protein, 10 aa, BORRELIA OppA
KVRKALTLAI

SEQ ID NO: 1566 - protein, 10 aa, BORRELIA OppA
SIFTQGYTQF

SEQ ID NO: 1567 - protein, 10 aa, BORRELIA OppA
SIFTHGYTQF

SEQ ID NO: 1568 - protein, 10 aa, BORRELIA OppA
KLQKLLFSVI

SEQ ID NO: 1569 - protein, 10 aa, BORRELIA OppA
KELDAIFVSI

SEQ ID NO: 1570 - protein, 10 aa, BORRELIA OppA
KITWSDGVPI

SEQ ID NO: 1571 - protein, 10 aa, BORRELIA OppA
KIRKALTLAI

SEQ ID NO: 1572 - protein, 10 aa, BORRELIA OppA
KSLELFNPEI

SEQ ID NO: 1573 - protein, 10 aa, BORRELIA OppA
ITAQDVVWSW

SEQ ID NO: 1574 - protein, 10 aa, BORRELIA OppA
VINKVTYLPI

SEQ ID NO: 1575 - protein, 10 aa, BORRELIA OppA
KTPDYASWPM

SEQ ID NO: 1576 - protein, 11 aa, BORRELIA OppA
KLQKLLFSVIF

SEQ ID NO: 1577 - protein, 12 aa, BORRELIA OppA
KLLFLIIFFLTF

SEQ ID NO: 1578 - protein, 12 aa, BORRELIA OppA
KLLFSVIFFLTF

SEQ ID NO: 1579 - protein, 12 aa, BORRELIA OppA
KSLFLIIFFLTF

SEQ ID NO: 1580 - protein, 12 aa, BORRELIA OppA
RSLFLIIFFLTF

SEQ ID NO: 1581 - protein, 12 aa, BORRELIA OppA
KTMLDTMHTHNF

SEQ ID NO: 1582 - protein, 9 aa, BORRELIA OppA
FLTFLCCNK

SEQ ID NO: 1583 - protein, 9 aa, BORRELIA OppA
FLCCNKEEK

SEQ ID NO: 1584 - protein, 9 aa, BORRELIA OppA
GTVYTFTLR

SEQ ID NO: 1585 - protein, 9 aa, BORRELIA OppA
VAITAEGIR

SEQ ID NO: 1586 - protein, 9 aa, BORRELIA OppA
EGIRKSYLR

SEQ ID NO: 1587 - protein, 9 aa, BORRELIA OppA
GSNYSEMVK

SEQ ID NO: 1588 - protein, 9 aa, BORRELIA OppA
LEITLESPK

SEQ ID NO: 1589 - protein, 9 aa, BORRELIA OppA
NIVTSGPFK

SEQ ID NO: 1590 - protein, 9 aa, BORRELIA OppA
VTSGPFKLK

SEQ ID NO: 1591 - protein, 9 aa, BORRELIA OppA
TTNDNSTAY

SEQ ID NO: 1592 - protein, 9 aa, BORRELIA OppA
TNDNSTAYK

SEQ ID NO: 1593 - protein, 9 aa, BORRELIA OppA
SAIPPDLIK

SEQ ID NO: 1594 - protein, 9 aa, BORRELIA OppA
DLIKDLKLR

SEQ ID NO: 1595 - protein, 9 aa, BORRELIA OppA
YSSAVNAIY

SEQ ID NO: 1596 - protein, 9 aa, BORRELIA OppA
SAVNAIYFY

SEQ ID NO: 1597 - protein, 9 aa, BORRELIA OppA
NAIYFYAFN

SEQ ID NO: 1598 - protein, 9 aa, BORRELIA OppA
FYAFNTHIK

SEQ ID NO: 1599 - protein, 9 aa, BORRELIA OppA
HIKPLDNVK

SEQ ID NO: 1600 - protein, 9 aa, BORRELIA OppA
NFSSYSYAK

SEQ ID NO: 1601 - protein, 9 aa, BORRELIA OppA
ELFNPEIAK

SEQ ID NO: 1602 - protein, 9 aa, BORRELIA OppA
NGNGFPILK

SEQ ID NO: 1603 - protein, 9 aa, BORRELIA OppA
NGFPILKLK

SEQ ID NO: 1604 - protein, 9 aa, BORRELIA OppA
YNTSEAHKK

SEQ ID NO: 1605 - protein, 9 aa, BORRELIA OppA
EFIQNQWKK

SEQ ID NO: 1606 - protein, 9 aa, BORRELIA OppA
LTFLSIFTQ

SEQ ID NO: 1607 - protein, 9 aa, BORRELIA OppA
YTQFSSHNY

SEQ ID NO: 1608 - protein, 9 aa, BORRELIA OppA
YIYGNSYLF

SEQ ID NO: 1609 - protein, 9 aa, BORRELIA OppA
NSYLFRNDK

SEQ ID NO: 1610 - protein, 9 aa, BORRELIA OppA
ERFDLSQLK

SEQ ID NO: 1611 - protein, 9 aa, BORRELIA OppA
FLSILTHGY

SEQ ID NO: 1612 - protein, 9 aa, BORRELIA OppA
LTFLSIFTH

SEQ ID NO: 1613 - protein, 9 aa, BORRELIA OppA
FLSIFTHGY

SEQ ID NO: 1614 - protein, 9 aa, BORRELIA OppA
SKMIDTMFR

SEQ ID NO: 1615 - protein, 9 aa, BORRELIA OppA
GSNYAEMVK

SEQ ID NO: 1616 - protein, 9 aa, BORRELIA OppA
TTNDSSTAY

SEQ ID NO: 1617 - protein, 9 aa, BORRELIA OppA
TNDSSTAYK

SEQ ID NO: 1618 - protein, 9 aa, BORRELIA OppA
TAYKMYENK

SEQ ID NO: 1619 - protein, 9 aa, BORRELIA OppA
GSIPPDLIK

SEQ ID NO: 1620 - protein, 9 aa, BORRELIA OppA
FYAFNTYIK

SEQ ID NO: 1621 - protein, 9 aa, BORRELIA OppA
YIKPLDNVK

SEQ ID NO: 1622 - protein, 9 aa, BORRELIA OppA
EWTTYLNTR

SEQ ID NO: 1623 - protein, 9 aa, BORRELIA OppA
FLTFLCCSK

SEQ ID NO: 1624 - protein, 9 aa, BORRELIA OppA
LAEDNVASK

SEQ ID NO: 1625 - protein, 9 aa, BORRELIA OppA
GSKYVEMVK

SEQ ID NO: 1626 - protein, 9 aa, BORRELIA OppA
NMVTSGPFK

SEQ ID NO: 1627 - protein, 9 aa, BORRELIA OppA
VSIPPDLIK

SEQ ID NO: 1628 - protein, 9 aa, BORRELIA OppA
FYAFNTTVK

SEQ ID NO: 1629 - protein, 9 aa, BORRELIA OppA
TVKPLDNVK

SEQ ID NO: 1630 - protein, 9 aa, BORRELIA OppA
YNTSDANKK

SEQ ID NO: 1631 - protein, 9 aa, BORRELIA OppA
NSEYNELIK

SEQ ID NO: 1632 - protein, 9 aa, BORRELIA OppA
QAEEIIIEK

SEQ ID NO: 1633 - protein, 9 aa, BORRELIA OppA
YVFEKNDKY

SEQ ID NO: 1634 - protein, 9 aa, BORRELIA OppA
IYFYAFNTK

SEQ ID NO: 1635 - protein, 9 aa, BORRELIA OppA
FYAFNTKVR

SEQ ID NO: 1636 - protein, 9 aa, BORRELIA OppA
LTFLCCNNK

SEQ ID NO: 1637 - protein, 9 aa, BORRELIA OppA
FLCCNNKER

SEQ ID NO: 1638 - protein, 9 aa, BORRELIA OppA
GTVYTFNLR

SEQ ID NO: 1639 - protein, 9 aa, BORRELIA OppA
YVFEKNNKY

SEQ ID NO: 1640 - protein, 9 aa, BORRELIA OppA
DLIKNLKLR

SEQ ID NO: 1641 - protein, 9 aa, BORRELIA OppA
EPASLDPHK

SEQ ID NO: 1642 - protein, 9 aa, BORRELIA OppA
EIQPRLAEK

SEQ ID NO: 1643 - protein, 9 aa, BORRELIA OppA
NTVWTFHLR

SEQ ID NO: 1644 - protein, 9 aa, BORRELIA OppA
QDVVWSWQR

SEQ ID NO: 1645 - protein, 9 aa, BORRELIA OppA
NGAAIAQGK

SEQ ID NO: 1646 - protein, 9 aa, BORRELIA OppA
HLVTSGAYK

SEQ ID NO: 1647 - protein, 9 aa, BORRELIA OppA
LSQWVVNER

SEQ ID NO: 1648 - protein, 9 aa, BORRELIA OppA
RIVAERNPR

SEQ ID NO: 1649 - protein, 9 aa, BORRELIA OppA
DNAHTVINK

SEQ ID NO: 1650 - protein, 9 aa, BORRELIA OppA
HTVINKVTY

SEQ ID NO: 1651 - protein, 9 aa, BORRELIA OppA
TSEAADVNR

SEQ ID NO: 1652 - protein, 9 aa, BORRELIA OppA
EAADVNRYK

SEQ ID NO: 1653 - protein, 9 aa, BORRELIA OppA
DVSPQLATY

SEQ ID NO: 1654 - protein, 9 aa, BORRELIA OppA
YYYEFNTTR

SEQ ID NO: 1655 - protein, 9 aa, BORRELIA OppA
YASWPMDKR

SEQ ID NO: 1656 - protein, 9 aa, BORRELIA OppA
MDKRIAEAK

SEQ ID NO: 1657 - protein, 9 aa, BORRELIA OppA
YNTSESHQR

SEQ ID NO: 1658 - protein, 9 aa, BORRELIA OppA
AIAASSMWK

SEQ ID NO: 1659 - protein, 9 aa, BORRELIA OppA
IAASSMWKK

SEQ ID NO: 1660 - protein, 9 aa, BORRELIA OppA
HTHNFDAVR

SEQ ID NO: 1661 - protein, 9 aa, BORRELIA OppA
AATFLNNFR

SEQ ID NO: 1662 - protein, 9 aa, BORRELIA OppA
DQALVNAAK

SEQ ID NO: 1663 - protein, 9 aa, BORRELIA OppA
AIPVYHYVR

SEQ ID NO: 1664 - protein, 9 aa, BORRELIA OppA
WVGGFTPDK

SEQ ID NO: 1665 - protein, 9 aa, BORRELIA OppA
FTPDKLGYY

SEQ ID NO: 1666 - protein, 9 aa, BORRELIA OppA
YTKDMYIKK

SEQ ID NO: 1667 - protein, 10 aa, BORRELIA OppA
FFLTFLCCNK

SEQ ID NO: 1668 - protein, 10 aa, BORRELIA OppA
GSKMIDTMFK

SEQ ID NO: 1669 - protein, 10 aa, BORRELIA OppA
DGTVYTFTLR

SEQ ID NO: 1670 - protein, 10 aa, BORRELIA OppA
TVYTFTLREK

SEQ ID NO: 1671 - protein, 10 aa, BORRELIA OppA
GVAITAEGIR

SEQ ID NO: 1672 - protein, 10 aa, BORRELIA OppA
VAITAEGIRK

SEQ ID NO: 1673 - protein, 10 aa, BORRELIA OppA
TGSNYSEMVK

SEQ ID NO: 1674 - protein, 10 aa, BORRELIA OppA
YSEMVKSTIK

SEQ ID NO: 1675 - protein, 10 aa, BORRELIA OppA
QVSDSELGIR

SEQ ID NO: 1676 - protein, 10 aa, BORRELIA OppA
ELGIRAIDEK

SEQ ID NO: 1677 - protein, 10 aa, BORRELIA OppA
TLEITLESPK

SEQ ID NO: 1678 - protein, 10 aa, BORRELIA OppA
ENIVTSGPFK

SEQ ID NO: 1679 - protein, 10 aa, BORRELIA OppA
IVTSGPFKLK

SEQ ID NO: 1680 - protein, 10 aa, BORRELIA OppA
TSGPFKLKER

SEQ ID NO: 1681 - protein, 10 aa, BORRELIA OppA
YTTNDNSTAY

SEQ ID NO: 1682 - protein, 10 aa, BORRELIA OppA
TTNDNSTAYK

SEQ ID NO: 1683 - protein, 10 aa, BORRELIA OppA
FSAIPPDLIK

SEQ ID NO: 1684 - protein, 10 aa, BORRELIA OppA
YYSSAVNAIY

SEQ ID NO: 1685 - protein, 10 aa, BORRELIA OppA
SSAVNAIYFY

SEQ ID NO: 1686 - protein, 10 aa, BORRELIA OppA
YFYAFNTHIK

SEQ ID NO: 1687 - protein, 10 aa, BORRELIA OppA
THIKPLDNVK

SEQ ID NO: 1688 - protein, 10 aa, BORRELIA OppA
ITPNFSSYSY

SEQ ID NO: 1689 - protein, 10 aa, BORRELIA OppA
LELFNPEIAK

SEQ ID NO: 1690 - protein, 10 aa, BORRELIA OppA
YTQFSSHNYS

SEQ ID NO: 1691 - protein, 10 aa, BORRELIA OppA
SSPEYNELIK

SEQ ID NO: 1692 - protein, 10 aa, BORRELIA OppA
DPIKRQDILR

SEQ ID NO: 1693 - protein, 10 aa, BORRELIA OppA
YIYGNSYLFR

SEQ ID NO: 1694 - protein, 10 aa, BORRELIA OppA
TERFDLSQLK

SEQ ID NO: 1695 - protein, 10 aa, BORRELIA OppA
GSKMIDTMFR

SEQ ID NO: 1696 - protein, 10 aa, BORRELIA OppA
TGSNYAEMVK

SEQ ID NO: 1697 - protein, 10 aa, BORRELIA OppA
YAEMVKSTIK

SEQ ID NO: 1698 - protein, 10 aa, BORRELIA OppA
YTTNDSSTAY

SEQ ID NO: 1699 - protein, 10 aa, BORRELIA OppA
TTNDSSTAYK

SEQ ID NO: 1700 - protein, 10 aa, BORRELIA OppA
STAYKMYENK

SEQ ID NO: 1701 - protein, 10 aa, BORRELIA OppA
FGSIPPDLIK

SEQ ID NO: 1702 - protein, 10 aa, BORRELIA OppA
YFYAFNTYIK

SEQ ID NO: 1703 - protein, 10 aa, BORRELIA OppA
TYIKPLDNVK

SEQ ID NO: 1704 - protein, 10 aa, BORRELIA OppA
EEWTTYLNTR

SEQ ID NO: 1705 - protein, 10 aa, BORRELIA OppA
FFLTFLCCSK

SEQ ID NO: 1706 - protein, 10 aa, BORRELIA OppA
LTFLCCSKEK

SEQ ID NO: 1707 - protein, 10 aa, BORRELIA OppA
EKAKEGVSFK

SEQ ID NO: 1708 - protein, 10 aa, BORRELIA OppA
QLAEDNVASK

SEQ ID NO: 1709 - protein, 10 aa, BORRELIA OppA
ASKMIDTMFR

SEQ ID NO: 1710 - protein, 10 aa, BORRELIA OppA
TGSKYVEMVK

SEQ ID NO: 1711 - protein, 10 aa, BORRELIA OppA
YVEMVKSAIK

SEQ ID NO: 1712 - protein, 10 aa, BORRELIA OppA
QVPDSEVGIR

SEQ ID NO: 1713 - protein, 10 aa, BORRELIA OppA
EVGIRAIDEK

SEQ ID NO: 1714 - protein, 10 aa, BORRELIA OppA
ENMVTSGPFK

SEQ ID NO: 1715 - protein, 10 aa, BORRELIA OppA
MVTSGPFKLK

SEQ ID NO: 1716 - protein, 10 aa, BORRELIA OppA
EVEVQEITFY

SEQ ID NO: 1717 - protein, 10 aa, BORRELIA OppA
FVSIPPDLIK

SEQ ID NO: 1718 - protein, 10 aa, BORRELIA OppA
YFYAFNTTVK

SEQ ID NO: 1719 - protein, 10 aa, BORRELIA OppA
TTVKPLDNVK

SEQ ID NO: 1720 - protein, 10 aa, BORRELIA OppA
SNSEYNELIK

SEQ ID NO: 1721 - protein, 10 aa, BORRELIA OppA
NSEYNELIKK

SEQ ID NO: 1722 - protein, 10 aa, BORRELIA OppA
YVFEKNDKYY

SEQ ID NO: 1723 - protein, 10 aa, BORRELIA OppA
EVEVQEIAFY

SEQ ID NO: 1724 - protein, 10 aa, BORRELIA OppA
AIYFYAFNTK

SEQ ID NO: 1725 - protein, 10 aa, BORRELIA OppA
YFYAFNTKVR

SEQ ID NO: 1726 - protein, 10 aa, BORRELIA OppA
FLTFLCCNNK

SEQ ID NO: 1727 - protein, 10 aa, BORRELIA OppA
DGTVYTFNLR

SEQ ID NO: 1728 - protein, 10 aa, BORRELIA OppA
TVYTFNLREK

SEQ ID NO: 1729 - protein, 10 aa, BORRELIA OppA
YVEMVKSVIK

SEQ ID NO: 1730 - protein, 10 aa, BORRELIA OppA
QVTDSELGIR

SEQ ID NO: 1731 - protein, 10 aa, BORRELIA OppA
YVFEKNNKYY

SEQ ID NO: 1732 - protein, 10 aa, BORRELIA OppA
QLAEKQELVR

SEQ ID NO: 1733 - protein, 10 aa, BORRELIA OppA
DNTVWTFHLR

SEQ ID NO: 1734 - protein, 10 aa, BORRELIA OppA
NTVWTFHLRP

SEQ ID NO: 1735 - protein, 10 aa, BORRELIA OppA
EHLVTSGAYK

SEQ ID NO: 1736 - protein, 10 aa, BORRELIA OppA
KLSQWVVNER

SEQ ID NO: 1737 - protein, 10 aa, BORRELIA OppA
VVNERIVAER

SEQ ID NO: 1738 - protein, 10 aa, BORRELIA OppA
ERIVAERNPR

SEQ ID NO: 1739 - protein, 10 aa, BORRELIA OppA
ITSEAADVNR

SEQ ID NO: 1740 - protein, 10 aa, BORRELIA OppA
SEAADVNRYK

SEQ ID NO: 1741 - protein, 10 aa, BORRELIA OppA
EAADVNRYKA

SEQ ID NO: 1742 - protein, 10 aa, BORRELIA OppA
YTVPINQFAQ

SEQ ID NO: 1743 - protein, 10 aa, BORRELIA OppA
DVSPQLATYY

SEQ ID NO: 1744 - protein, 10 aa, BORRELIA OppA
TYYYEFNTTR

SEQ ID NO: 1745 - protein, 10 aa, BORRELIA OppA
TTRPPFNDVR

SEQ ID NO: 1746 - protein, 10 aa, BORRELIA OppA
DYASWPMDKR

SEQ ID NO: 1747 - protein, 10 aa, BORRELIA OppA
YASWPMDKRI

SEQ ID NO: 1748 - protein, 10 aa, BORRELIA OppA
IAIAASSMWK

SEQ ID NO: 1749 - protein, 10 aa, BORRELIA OppA
AIAASSMWKK

SEQ ID NO: 1750 - protein, 10 aa, BORRELIA OppA
EAKLQNQEWK

SEQ ID NO: 1751 - protein, 10 aa, BORRELIA OppA
MHTHNFDAVR

SEQ ID NO: 1752 - protein, 10 aa, BORRELIA OppA
HTHNFDAVRY

SEQ ID NO: 1753 - protein, 10 aa, BORRELIA OppA
DAATFLNNFR

SEQ ID NO: 1754 - protein, 10 aa, BORRELIA OppA
NTSQYSNPDY

SEQ ID NO: 1755 - protein, 10 aa, BORRELIA OppA
YDQALVNAAK

SEQ ID NO: 1756 - protein, 10 aa, BORRELIA OppA
DVPAIPVYHY

SEQ ID NO: 1757 - protein, 10 aa, BORRELIA OppA
PAIPVYHYVR

SEQ ID NO: 1758 - protein, 10 aa, BORRELIA OppA
FTPDKLGYYY

SEQ ID NO: 1759 - protein, 10 aa, BORRELIA OppA
YYYTKDMYIK

SEQ ID NO: 1760 - protein, 10 aa, BORRELIA OppA
YYTKDMYIKK

SEQ ID NO: 1761 - protein, 11 aa, BORRELIA OppA
PDGTVYTFTLR

SEQ ID NO: 1762 - protein, 11 aa, BORRELIA OppA
GTVYTFTLREK

SEQ ID NO: 1763 - protein, 11 aa, BORRELIA OppA
TAEGIRKSYLR

SEQ ID NO: 1764 - protein, 11 aa, BORRELIA OppA
ETGSNYSEMVK

SEQ ID NO: 1765 - protein, 11 aa, BORRELIA OppA
YTTNDNSTAYK

SEQ ID NO: 1766 - protein, 11 aa, BORRELIA OppA
IYIYGNSYLFR

SEQ ID NO: 1767 - protein, 11 aa, BORRELIA OppA
YIYGNSYLFRN

SEQ ID NO: 1768 - protein, 11 aa, BORRELIA OppA
ITERFDLSQLK

SEQ ID NO: 1769 - protein, 11 aa, BORRELIA OppA
YTTNDSSTAYK

SEQ ID NO: 1770 - protein, 11 aa, BORRELIA OppA
NAIYFYAFNTY

SEQ ID NO: 1771 - protein, 11 aa, BORRELIA OppA
IYFYAFNTYIK

SEQ ID NO: 1772 - protein, 11 aa, BORRELIA OppA
NTYIKPLDNVK

SEQ ID NO: 1773 - protein, 11 aa, BORRELIA OppA
VASKMIDTMFR

SEQ ID NO: 1774 - protein, 11 aa, BORRELIA OppA
ETGSKYVEMVK

SEQ ID NO: 1775 - protein, 11 aa, BORRELIA OppA
NMVTSGPFKLK

SEQ ID NO: 1776 - protein, 11 aa, BORRELIA OppA
SDGTVYTFTLR

SEQ ID NO: 1777 - protein, 11 aa, BORRELIA OppA
NAIYFYAFNTK

SEQ ID NO: 1778 - protein, 11 aa, BORRELIA OppA
LAIDRETLAYK

SEQ ID NO: 1779 - protein, 11 aa, BORRELIA OppA
SDGTVYTFNLR

SEQ ID NO: 1780 - protein, 11 aa, BORRELIA OppA
GTVYTFNLREK

SEQ ID NO: 1781 - protein, 11 aa, BORRELIA OppA
KDNTVWTFHLR

SEQ ID NO: 1782 - protein, 11 aa, BORRELIA OppA
TAQDVVWSWQR

SEQ ID NO: 1783 - protein, 11 aa, BORRELIA OppA
WVVNERIVAER

SEQ ID NO: 1784 - protein, 11 aa, BORRELIA OppA
TSEAADVNRYK

SEQ ID NO: 1785 - protein, 11 aa, BORRELIA OppA
ATYYYEFNTTR

SEQ ID NO: 1786 - protein, 11 aa, BORRELIA OppA
NTTRPPFNDVR

SEQ ID NO: 1787 - protein, 11 aa, BORRELIA OppA
TMHTHNFDAVR

SEQ ID NO: 1788 - protein, 11 aa, BORRELIA OppA
DDAATFLNNFR

SEQ ID NO: 1789 - protein, 11 aa, BORRELIA OppA
DAATFLNNFRT

SEQ ID NO: 1790 - protein, 12 aa, BORRELIA OppA
IIFFLTFLCCNK

SEQ ID NO: 1791 - protein, 12 aa, BORRELIA OppA
NVGSKMIDTMFK

SEQ ID NO: 1792 - protein, 12 aa, BORRELIA OppA
SPDGTVYTFTLR

SEQ ID NO: 1793 - protein, 12 aa, BORRELIA OppA
DGTVYTFTLREK

SEQ ID NO: 1794 - protein, 12 aa, BORRELIA OppA
ITAEGIRKSYLR

SEQ ID NO: 1795 - protein, 12 aa, BORRELIA OppA
FYTTNDNSTAYK

SEQ ID NO: 1796 - protein, 12 aa, BORRELIA OppA
ITPNFSSYSYAK

SEQ ID NO: 1797 - protein, 12 aa, BORRELIA OppA
NTKSNGNYEIAR

SEQ ID NO: 1798 - protein, 12 aa, BORRELIA OppA
PIYIYGNSYLFR

SEQ ID NO: 1799 - protein, 12 aa, BORRELIA OppA
IYIYGNSYLFRN

SEQ ID NO: 1800 - protein, 12 aa, BORRELIA OppA
NITERFDLSQLK

SEQ ID NO: 1801 - protein, 12 aa, BORRELIA OppA
VIFFLTFLCCNK

SEQ ID NO: 1802 - protein, 12 aa, BORRELIA OppA
NVGSKMIDTMFR

SEQ ID NO: 1803 - protein, 12 aa, BORRELIA OppA
FYTTNDSSTAYK

SEQ ID NO: 1804 - protein, 12 aa, BORRELIA OppA
VNAIYFYAFNTY

SEQ ID NO: 1805 - protein, 12 aa, BORRELIA OppA
AIYFYAFNTYIK

SEQ ID NO: 1806 - protein, 12 aa, BORRELIA OppA
FNTYIKPLDNVK

SEQ ID NO: 1807 - protein, 12 aa, BORRELIA OppA
IIFFLTFLCCSK

SEQ ID NO: 1808 - protein, 12 aa, BORRELIA OppA
NVASKMIDTMFR

SEQ ID NO: 1809 - protein, 12 aa, BORRELIA OppA
KETGSKYVEMVK

SEQ ID NO: 1810 - protein, 12 aa, BORRELIA OppA
ENMVTSGPFKLK

SEQ ID NO: 1811 - protein, 12 aa, BORRELIA OppA
MVTSGPFKLKER

SEQ ID NO: 1812 - protein, 12 aa, BORRELIA OppA
NISERFDLSQLK

SEQ ID NO: 1813 - protein, 12 aa, BORRELIA OppA
SSDGTVYTFTLR

SEQ ID NO: 1814 - protein, 12 aa, BORRELIA OppA
VNAIYFYAFNTK

SEQ ID NO: 1815 - protein, 12 aa, BORRELIA OppA
NAIYFYAFNTKV

SEQ ID NO: 1816 - protein, 12 aa, BORRELIA OppA
AIYFYAFNTKVR

SEQ ID NO: 1817 - protein, 12 aa, BORRELIA OppA
TLAIDRETLAYK

SEQ ID NO: 1818 - protein, 12 aa, BORRELIA OppA
NTKANGNYEIAR

SEQ ID NO: 1819 - protein, 12 aa, BORRELIA OppA
FLTFLCCNNKER

SEQ ID NO: 1820 - protein, 12 aa, BORRELIA OppA
SSDGTVYTFNLR

SEQ ID NO: 1821 - protein, 12 aa, BORRELIA OppA
DGTVYTFNLREK

SEQ ID NO: 1822 - protein, 12 aa, BORRELIA OppA
NILERFDLSQLK

SEQ ID NO: 1823 - protein, 12 aa, BORRELIA OppA
NKDNTVWTFHLR

SEQ ID NO: 1824 - protein, 12 aa, BORRELIA OppA
ITAQDVVWSWQR

SEQ ID NO: 1825 - protein, 12 aa, BORRELIA OppA
QWVVNERIVAER

SEQ ID NO: 1826 - protein, 12 aa, BORRELIA OppA
ITSEAADVNRYK

SEQ ID NO: 1827 - protein, 12 aa, BORRELIA OppA
YTVPINQFAQLK

SEQ ID NO: 1828 - protein, 12 aa, BORRELIA OppA
LATYYYEFNTTR

SEQ ID NO: 1829 - protein, 12 aa, BORRELIA OppA
FNTTRPPFNDVR

SEQ ID NO: 1830 - protein, 12 aa, BORRELIA OppA
TPDYASWPMDKR

SEQ ID NO: 1831 - protein, 12 aa, BORRELIA OppA
DTMHTHNFDAVR

SEQ ID NO: 1832 - protein, 12 aa, BORRELIA OppA
YDDAATFLNNFR

SEQ ID NO: 1833 - protein, 12 aa, BORRELIA OppA
DVPAIPVYHYVR

SEQ ID NO: 1834 - protein, 12 aa, BORRELIA OppA
FTPDKLGYYYTK

SEQ ID NO: 1835 - protein, 9 aa, BORRELIA OppA
SPDGTVYTF

SEQ ID NO: 1836 - protein, 9 aa, BORRELIA OppA
SPKPYFIDM

SEQ ID NO: 1837 - protein, 9 aa, BORRELIA OppA
KPYFIDMLV

SEQ ID NO: 1838 - protein, 9 aa, BORRELIA OppA
NPEIAKTLL

SEQ ID NO: 1839 - protein, 9 aa, BORRELIA OppA
YPNGNGFPI

SEQ ID NO: 1840 - protein, 9 aa, BORRELIA OppA
QPNAAFLAM

SEQ ID NO: 1841 - protein, 9 aa, BORRELIA OppA
LAMLAHPSM

SEQ ID NO: 1842 - protein, 9 aa, BORRELIA OppA
NPRYWDNAH

SEQ ID NO: 1843 - protein, 9 aa, BORRELIA OppA
VPINQFAQL

SEQ ID NO: 1844 - protein, 9 aa, BORRELIA OppA
RVRKALNMA

SEQ ID NO: 1845 - protein, 9 aa, BORRELIA OppA
QPDIGGVTL

SEQ ID NO: 1846 - protein, 9 aa, BORRELIA OppA
TPDYASWPM

SEQ ID NO: 1847 - protein, 9 aa, BORRELIA OppA
WPMDKRIAE

SEQ ID NO: 1848 - protein, 9 aa, BORRELIA OppA
RIAIAASSM

SEQ ID NO: 1849 - protein, 10 aa, BORRELIA OppA
KPGLAKSWDI

SEQ ID NO: 1850 - protein, 10 aa, BORRELIA OppA
SPKPYFIDML

SEQ ID NO: 1851 - protein, 10 aa, BORRELIA OppA
KVRKALTLAI

SEQ ID NO: 1852 - protein, 10 aa, BORRELIA OppA
TPTRRITPNF

SEQ ID NO: 1853 - protein, 10 aa, BORRELIA OppA
FNPEIAKTLL

SEQ ID NO: 1854 - protein, 10 aa, BORRELIA OppA
GYPNGNGFPI

SEQ ID NO: 1855 - protein, 10 aa, BORRELIA OppA
YPNGNGFPIL

SEQ ID NO: 1856 - protein, 10 aa, BORRELIA OppA
ADPLTFLSIL

SEQ ID NO: 1857 - protein, 10 aa, BORRELIA OppA
TPTRRIAPNF

SEQ ID NO: 1858 - protein, 10 aa, BORRELIA OppA
RPGLAKSWNI

SEQ ID NO: 1859 - protein, 10 aa, BORRELIA OppA
TPTRRATPNF

SEQ ID NO: 1860 - protein, 10 aa, BORRELIA OppA
ADPATFLSIF

SEQ ID NO: 1861 - protein, 10 aa, BORRELIA OppA
RPGLAKSWDI

SEQ ID NO: 1862 - protein, 10 aa, BORRELIA OppA
KPGLAKGWDI

SEQ ID NO: 1863 - protein, 10 aa, BORRELIA OppA
KIRKALTLAI

SEQ ID NO: 1864 - protein, 10 aa, BORRELIA OppA
SPTGEIQPRL

SEQ ID NO: 1865 - protein, 10 aa, BORRELIA OppA
SPYASYPGNM

SEQ ID NO: 1866 - protein, 10 aa, BORRELIA OppA
APDTLGVKAL

SEQ ID NO: 1867 - protein, 10 aa, BORRELIA OppA
TQPNAAFLAM

SEQ ID NO: 1868 - protein, 10 aa, BORRELIA OppA
QPNAAFLAML

SEQ ID NO: 1869 - protein, 10 aa, BORRELIA OppA
KPEHLVTSGA

SEQ ID NO: 1870 - protein, 10 aa, BORRELIA OppA
RNPRYWDNAH

SEQ ID NO: 1871 - protein, 10 aa, BORRELIA OppA
NPRYWDNAHT

SEQ ID NO: 1872 - protein, 10 aa, BORRELIA OppA
LPITSEAADV

SEQ ID NO: 1873 - protein, 10 aa, BORRELIA OppA
TVPINQFAQL

SEQ ID NO: 1874 - protein, 10 aa, BORRELIA OppA
RVRKALNMAL

SEQ ID NO: 1875 - protein, 10 aa, BORRELIA OppA
SQPDIGGVTL

SEQ ID NO: 1876 - protein, 10 aa, BORRELIA OppA
KTPDYASWPM

SEQ ID NO: 1877 - protein, 10 aa, BORRELIA OppA
SWPMDKRIAE

SEQ ID NO: 1878 - protein, 10 aa, BORRELIA OppA
WPMDKRIAEA

SEQ ID NO: 1879 - protein, 10 aa, BORRELIA OppA
VPAIPVYHYV

SEQ ID NO: 1880 - protein, 11 aa, BORRELIA OppA
SPDGTVYTFTL

SEQ ID NO: 1881 - protein, 11 aa, BORRELIA OppA
AGYPNGNGFPI

SEQ ID NO: 1882 - protein, 11 aa, BORRELIA OppA
GYPNGNGFPIL

SEQ ID NO: 1883 - protein, 11 aa, BORRELIA OppA
YPNGNGFPILK

SEQ ID NO: 1884 - protein, 11 aa, BORRELIA OppA
APIYIYGNSYL

SEQ ID NO: 1885 - protein, 11 aa, BORRELIA OppA
SPENIVTSGPF

SEQ ID NO: 1886 - protein, 11 aa, BORRELIA OppA
SPENMVTSGPF

SEQ ID NO: 1887 - protein, 11 aa, BORRELIA OppA
LTQPNAAFLAM

SEQ ID NO: 1888 - protein, 11 aa, BORRELIA OppA
TQPNAAFLAML

SEQ ID NO: 1889 - protein, 11 aa, BORRELIA OppA
NPRYWDNAHTV

SEQ ID NO: 1890 - protein, 11 aa, BORRELIA OppA
VRVRKALNMAL

SEQ ID NO: 1891 - protein, 11 aa, BORRELIA OppA
RVRKALNMALD

SEQ ID NO: 1892 - protein, 11 aa, BORRELIA OppA
RPAWLISQPDI

SEQ ID NO: 1893 - protein, 11 aa, BORRELIA OppA
SWPMDKRIAEA

SEQ ID NO: 1894 - protein, 11 aa, BORRELIA OppA
WPMDKRIAEAK

SEQ ID NO: 1895 - protein, 11 aa, BORRELIA OppA
IPVYHYVRTHL

SEQ ID NO: 1896 - protein, 12 aa, BORRELIA OppA
KPLDNVKVRKAL

SEQ ID NO: 1897 - protein, 12 aa, BORRELIA OppA
AGYPNGNGFPIL

SEQ ID NO: 1898 - protein, 12 aa, BORRELIA OppA
YPNGNGFPILKL

SEQ ID NO: 1899 - protein, 12 aa, BORRELIA OppA
TSPENMVTSGPF

SEQ ID NO: 1900 - protein, 12 aa, BORRELIA OppA
SPENMVTSGPFK

SEQ ID NO: 1901 - protein, 12 aa, BORRELIA OppA
RPLDNVKVRKAL

SEQ ID NO: 1902 - protein, 12 aa, BORRELIA OppA
KPLDNVKIRKAL

SEQ ID NO: 1903 - protein, 12 aa, BORRELIA OppA
RPGITWSDGTAI

SEQ ID NO: 1904 - protein, 12 aa, BORRELIA OppA
TLTQPNAAFLAM

SEQ ID NO: 1905 - protein, 12 aa, BORRELIA OppA
LTQPNAAFLAML

SEQ ID NO: 1906 - protein, 12 aa, BORRELIA OppA
NPRYWDNAHTVI

SEQ ID NO: 1907 - protein, 12 aa, BORRELIA OppA
DVRVRKALNMAL

SEQ ID NO: 1908 - protein, 12 aa, BORRELIA OppA
VRVRKALNMALD

SEQ ID NO: 1909 - protein, 12 aa, BORRELIA OppA
RVRKALNMALDK

SEQ ID NO: 1910 - protein, 12 aa, BORRELIA OppA
KPWVGGFTPDKL

SEQ ID NO: 1911 - protein, 9 aa, BORRELIA OppA
MKLQKLLFL

SEQ ID NO: 1912 - protein, 9 aa, BORRELIA OppA
FLIIFFLTF

SEQ ID NO: 1913 - protein, 9 aa, BORRELIA OppA
SPKPYFIDM

SEQ ID NO: 1914 - protein, 9 aa, BORRELIA OppA
VNAIYFYAF

SEQ ID NO: 1915 - protein, 9 aa, BORRELIA OppA
ILKLKYNTS

SEQ ID NO: 1916 - protein, 9 aa, BORRELIA OppA
EAHKKICEF

SEQ ID NO: 1917 - protein, 9 aa, BORRELIA OppA
LIKKSDLEL

SEQ ID NO: 1918 - protein, 9 aa, BORRELIA OppA
MKLQKSLFL

SEQ ID NO: 1919 - protein, 9 aa, BORRELIA OppA
MKLQKSLLF

SEQ ID NO: 1920 - protein, 9 aa, BORRELIA OppA
MKLQRSLFL

SEQ ID NO: 1921 - protein, 9 aa, BORRELIA OppA
YSYAKSLEL

SEQ ID NO: 1922 - protein, 9 aa, BORRELIA OppA
EANKKICEF

SEQ ID NO: 1923 - protein, 9 aa, BORRELIA OppA
LAMLAHPSM

SEQ ID NO: 1924 - protein, 9 aa, BORRELIA OppA
VPINQFAQL

SEQ ID NO: 1925 - protein, 9 aa, BORRELIA OppA
QLATYYYEF

SEQ ID NO: 1926 - protein, 9 aa, BORRELIA OppA
WPMDKRIAE

SEQ ID NO: 1927 - protein, 9 aa, BORRELIA OppA
FNASHPLSF

SEQ ID NO: 1928 - protein, 9 aa, BORRELIA OppA
SMWKKNLGV

SEQ ID NO: 1929 - protein, 10 aa, BORRELIA OppA
FLIIFFLTFL

SEQ ID NO: 1930 - protein, 10 aa, BORRELIA OppA
ESPKPYFIDM

SEQ ID NO: 1931 - protein, 10 aa, BORRELIA OppA
SPKPYFIDML

SEQ ID NO: 1932 - protein, 10 aa, BORRELIA OppA
FIDMLVHQSF

SEQ ID NO: 1933 - protein, 10 aa, BORRELIA OppA
MLVHQSFIPI

SEQ ID NO: 1934 - protein, 10 aa, BORRELIA OppA
YAFNTHIKPL

SEQ ID NO: 1935 - protein, 10 aa, BORRELIA OppA
NVKVRKALTL

SEQ ID NO: 1936 - protein, 10 aa, BORRELIA OppA
ELIKKSDLEL

SEQ ID NO: 1937 - protein, 10 aa, BORRELIA OppA
YAFNTYIKPL

SEQ ID NO: 1938 - protein, 10 aa, BORRELIA OppA
MKLQKSLLFL

SEQ ID NO: 1939 - protein, 10 aa, BORRELIA OppA
YAFNTKVRPL

SEQ ID NO: 1940 - protein, 10 aa, BORRELIA OppA
NVKIRKALTL

SEQ ID NO: 1941 - protein, 10 aa, BORRELIA OppA
QSRTNFTLSL

SEQ ID NO: 1942 - protein, 10 aa, BORRELIA OppA
FLAMLAHPSM

SEQ ID NO: 1943 - protein, 10 aa, BORRELIA OppA
WPMDKRIAEA

SEQ ID NO: 1944 - protein, 11 aa, BORRELIA OppA
FYAFNTHIKPL

SEQ ID NO: 1945 - protein, 11 aa, BORRELIA OppA
DNVKVRKALTL

SEQ ID NO: 1946 - protein, 11 aa, BORRELIA OppA
DNVKIRKALTL

SEQ ID NO: 1947 - protein, 11 aa, BORRELIA OppA
SWPMDKRIAEA

SEQ ID NO: 1948 - protein, 12 aa, BORRELIA OppA
YFYAFNTHIKPL

SEQ ID NO: 1949 - protein, 12 aa, BORRELIA OppA
LDNVKVRKALTL

SEQ ID NO: 1950 - protein, 12 aa, BORRELIA OppA
YFYAFNTKVRPL

SEQ ID NO: 1951 - protein, 12 aa, BORRELIA OppA
NLKLRSDYYSSA

SEQ ID NO: 1952 - protein, 12 aa, BORRELIA OppA
LDNVKIRKALTL

SEQ ID NO: 1953 - protein, 12 aa, BORRELIA OppA
ASWPMDKRIAEA

SEQ ID NO: 1954 - protein, 9 aa, BORRELIA OppA
MKLQKLLFL

SEQ ID NO: 1955 - protein, 9 aa, BORRELIA OppA
LQKLLFLII

SEQ ID NO: 1956 - protein, 9 aa, BORRELIA OppA
QKLLFLIIF

SEQ ID NO: 1957 - protein, 9 aa, BORRELIA OppA
KLLFLIIFF

SEQ ID NO: 1958 - protein, 9 aa, BORRELIA OppA
FLIIFFLTF

SEQ ID NO: 1959 - protein, 9 aa, BORRELIA OppA
EEKKEGVSF

SEQ ID NO: 1960 - protein, 9 aa, BORRELIA OppA
GSKMIDTMF

SEQ ID NO: 1961 - protein, 9 aa, BORRELIA OppA
TMFKGLITG

SEQ ID NO: 1962 - protein, 9 aa, BORRELIA OppA
YTFTLREKI

SEQ ID NO: 1963 - protein, 9 aa, BORRELIA OppA
IIWSDGVAI

SEQ ID NO: 1964 - protein, 9 aa, BORRELIA OppA
IRKSYLRIL

SEQ ID NO: 1965 - protein, 9 aa, BORRELIA OppA
LNKETGSNY

SEQ ID NO: 1966 - protein, 9 aa, BORRELIA OppA
STIKNGQKY

SEQ ID NO: 1967 - protein, 9 aa, BORRELIA OppA
GQKYFDGQV

SEQ ID NO: 1968 - protein, 9 aa, BORRELIA OppA
QKYFDGQVS

SEQ ID NO: 1969 - protein, 9 aa, BORRELIA OppA
ITLESPKPY

SEQ ID NO: 1970 - protein, 9 aa, BORRELIA OppA
TLESPKPYF

SEQ ID NO: 1971 - protein, 9 aa, BORRELIA OppA
IDMLVHQSF

SEQ ID NO: 1972 - protein, 9 aa, BORRELIA OppA
DMLVHQSFI

SEQ ID NO: 1973 - protein, 9 aa, BORRELIA OppA
LVHQSFIPI

SEQ ID NO: 1974 - protein, 9 aa, BORRELIA OppA
HQSFIPIPI

SEQ ID NO: 1975 - protein, 9 aa, BORRELIA OppA
IAEKYGQSW

SEQ ID NO: 1976 - protein, 9 aa, BORRELIA OppA
QSWTNPENI

SEQ ID NO: 1977 - protein, 9 aa, BORRELIA OppA
ENIVTSGPF

SEQ ID NO: 1978 - protein, 9 aa, BORRELIA OppA
FKLKERIPN

SEQ ID NO: 1979 - protein, 9 aa, BORRELIA OppA
KERIPNEKY

SEQ ID NO: 1980 - protein, 9 aa, BORRELIA OppA
DKYYNSNQV

SEQ ID NO: 1981 - protein, 9 aa, BORRELIA OppA
KYYNSNQVE

SEQ ID NO: 1982 - protein, 9 aa, BORRELIA OppA
VEVQEITFY

SEQ ID NO: 1983 - protein, 9 aa, BORRELIA OppA
TTNDNSTAY

SEQ ID NO: 1984 - protein, 9 aa, BORRELIA OppA
YKMYENGEL

SEQ ID NO: 1985 - protein, 9 aa, BORRELIA OppA
KMYENGELD

SEQ ID NO: 1986 - protein, 9 aa, BORRELIA OppA
LKLRSDYYS

SEQ ID NO: 1987 - protein, 9 aa, BORRELIA OppA
KLRSDYYSS

SEQ ID NO: 1988 - protein, 9 aa, BORRELIA OppA
LRSDYYSSA

SEQ ID NO: 1989 - protein, 9 aa, BORRELIA OppA
RSDYYSSAV

SEQ ID NO: 1990 - protein, 9 aa, BORRELIA OppA
YSSAVNAIY

SEQ ID NO: 1991 - protein, 9 aa, BORRELIA OppA
SSAVNAIYF

SEQ ID NO: 1992 - protein, 9 aa, BORRELIA OppA
SAVNAIYFY

SEQ ID NO: 1993 - protein, 9 aa, BORRELIA OppA
VNAIYFYAF

SEQ ID NO: 1994 - protein, 9 aa, BORRELIA OppA
YFYAFNTHI

SEQ ID NO: 1995 - protein, 9 aa, BORRELIA OppA
VKVRKALTL

SEQ ID NO: 1996 - protein, 9 aa, BORRELIA OppA
VRKALTLAI

SEQ ID NO: 1997 - protein, 9 aa, BORRELIA OppA
PTRRITPNF

SEQ ID NO: 1998 - protein, 9 aa, BORRELIA OppA
RITPNFSSY

SEQ ID NO: 1999 - protein, 9 aa, BORRELIA OppA
FSSYSYAKN

SEQ ID NO: 2000 - protein, 9 aa, BORRELIA OppA
SSYSYAKNL

SEQ ID NO: 2001 - protein, 9 aa, BORRELIA OppA
YSYAKNLEL

SEQ ID NO: 2002 - protein, 9 aa, BORRELIA OppA
KTLLAEAGY

SEQ ID NO: 2003 - protein, 9 aa, BORRELIA OppA
AGYPNGNGF

SEQ ID NO: 2004 - protein, 9 aa, BORRELIA OppA
LKLKYNTSE

SEQ ID NO: 2005 - protein, 9 aa, BORRELIA OppA
KLKYNTSEA

SEQ ID NO: 2006 - protein, 9 aa, BORRELIA OppA
LKYNTSEAH

SEQ ID NO: 2007 - protein, 9 aa, BORRELIA OppA
EAHKKICEF

SEQ ID NO: 2008 - protein, 9 aa, BORRELIA OppA
NQWKKILNI

SEQ ID NO: 2009 - protein, 9 aa, BORRELIA OppA
LENEEWTTY

SEQ ID NO: 2010 - protein, 9 aa, BORRELIA OppA
LNTKSNGNY

SEQ ID NO: 2011 - protein, 9 aa, BORRELIA OppA
TKSNGNYEI

SEQ ID NO: 2012 - protein, 9 aa, BORRELIA OppA
GDYADPLTF

SEQ ID NO: 2013 - protein, 9 aa, BORRELIA OppA
FLSIFTQGY

SEQ ID NO: 2014 - protein, 9 aa, BORRELIA OppA
QGYTQFSSH

SEQ ID NO: 2015 - protein, 9 aa, BORRELIA OppA
YTQFSSHNY

SEQ ID NO: 2016 - protein, 9 aa, BORRELIA OppA
TQFSSHNYS

SEQ ID NO: 2017 - protein, 9 aa, BORRELIA OppA
SSHNYSSPE

SEQ ID NO: 2018 - protein, 9 aa, BORRELIA OppA
SHNYSSPEY

SEQ ID NO: 2019 - protein, 9 aa, BORRELIA OppA
YSSPEYNEL

SEQ ID NO: 2020 - protein, 9 aa, BORRELIA OppA
KDFPIAPIY

SEQ ID NO: 2021 - protein, 9 aa, BORRELIA OppA
FPIAPIYIY

SEQ ID NO: 2022 - protein, 9 aa, BORRELIA OppA
PIYIYGNSY

SEQ ID NO: 2023 - protein, 9 aa, BORRELIA OppA
YIYGNSYLF

SEQ ID NO: 2024 - protein, 9 aa, BORRELIA OppA
LTFLSILTH

SEQ ID NO: 2025 - protein, 9 aa, BORRELIA OppA
FLSILTHGY

SEQ ID NO: 2026 - protein, 9 aa, BORRELIA OppA
ILTHGYTQF

SEQ ID NO: 2027 - protein, 9 aa, BORRELIA OppA
HGYTQFSSH

SEQ ID NO: 2028 - protein, 9 aa, BORRELIA OppA
LTFLSIFTH

SEQ ID NO: 2029 - protein, 9 aa, BORRELIA OppA
FLSIFTHGY

SEQ ID NO: 2030 - protein, 9 aa, BORRELIA OppA
IFTHGYTQF

SEQ ID NO: 2031 - protein, 9 aa, BORRELIA OppA
LQKLLFSVI

SEQ ID NO: 2032 - protein, 9 aa, BORRELIA OppA
QKLLFSVIF

SEQ ID NO: 2033 - protein, 9 aa, BORRELIA OppA
KLLFSVIFF

SEQ ID NO: 2034 - protein, 9 aa, BORRELIA OppA
LLFSVIFFL

SEQ ID NO: 2035 - protein, 9 aa, BORRELIA OppA
FSVIFFLTF

SEQ ID NO: 2036 - protein, 9 aa, BORRELIA OppA
EEKKEGISF

SEQ ID NO: 2037 - protein, 9 aa, BORRELIA OppA
QSWTSPENI

SEQ ID NO: 2038 - protein, 9 aa, BORRELIA OppA
TTNDSSTAY

SEQ ID NO: 2039 - protein, 9 aa, BORRELIA OppA
YKMYENKEL

SEQ ID NO: 2040 - protein, 9 aa, BORRELIA OppA
IYFYAFNTY

SEQ ID NO: 2041 - protein, 9 aa, BORRELIA OppA
YFYAFNTYI

SEQ ID NO: 2042 - protein, 9 aa, BORRELIA OppA
PTRRIAPNF

SEQ ID NO: 2043 - protein, 9 aa, BORRELIA OppA
RIAPNFSSY

SEQ ID NO: 2044 - protein, 9 aa, BORRELIA OppA
APNFSSYSY

SEQ ID NO: 2045 - protein, 9 aa, BORRELIA OppA
LNTRSNGNY

SEQ ID NO: 2046 - protein, 9 aa, BORRELIA OppA
MKLQKSLFL

SEQ ID NO: 2047 - protein, 9 aa, BORRELIA OppA
KLQKSLFLI

SEQ ID NO: 2048 - protein, 9 aa, BORRELIA OppA
LQKSLFLII

SEQ ID NO: 2049 - protein, 9 aa, BORRELIA OppA
QKSLFLIIF

SEQ ID NO: 2050 - protein, 9 aa, BORRELIA OppA
KSLFLIIFF

SEQ ID NO: 2051 - protein, 9 aa, BORRELIA OppA
EKAKEGVSF

SEQ ID NO: 2052 - protein, 9 aa, BORRELIA OppA
ASKMIDTMF

SEQ ID NO: 2053 - protein, 9 aa, BORRELIA OppA
NISPDGTVY

SEQ ID NO: 2054 - protein, 9 aa, BORRELIA OppA
ITWSDGVAI

SEQ ID NO: 2055 - protein, 9 aa, BORRELIA OppA
LNKETGSKY

SEQ ID NO: 2056 - protein, 9 aa, BORRELIA OppA
SAIKNGQKY

SEQ ID NO: 2057 - protein, 9 aa, BORRELIA OppA
AIKNGQKYF

SEQ ID NO: 2058 - protein, 9 aa, BORRELIA OppA
GQKYFDEQV

SEQ ID NO: 2059 - protein, 9 aa, BORRELIA OppA
QSWTSPENM

SEQ ID NO: 2060 - protein, 9 aa, BORRELIA OppA
ENMVTSGPF

SEQ ID NO: 2061 - protein, 9 aa, BORRELIA OppA
DKYYNSNEV

SEQ ID NO: 2062 - protein, 9 aa, BORRELIA OppA
KLRNDYYSS

SEQ ID NO: 2063 - protein, 9 aa, BORRELIA OppA
RNDYYSSAV

SEQ ID NO: 2064 - protein, 9 aa, BORRELIA OppA
YFYAFNTTV

SEQ ID NO: 2065 - protein, 9 aa, BORRELIA OppA
PTRRATPNF

SEQ ID NO: 2066 - protein, 9 aa, BORRELIA OppA
RATPNFSSY

SEQ ID NO: 2067 - protein, 9 aa, BORRELIA OppA
LKLKYNTSD

SEQ ID NO: 2068 - protein, 9 aa, BORRELIA OppA
LKYNTSDAN

SEQ ID NO: 2069 - protein, 9 aa, BORRELIA OppA
NQWKKNLNI

SEQ ID NO: 2070 - protein, 9 aa, BORRELIA OppA
GDYADPATF

SEQ ID NO: 2071 - protein, 9 aa, BORRELIA OppA
SHNYSNSEY

SEQ ID NO: 2072 - protein, 9 aa, BORRELIA OppA
YSNSEYNEL

SEQ ID NO: 2073 - protein, 9 aa, BORRELIA OppA
MKLQKSLLF

SEQ ID NO: 2074 - protein, 9 aa, BORRELIA OppA
KLQKSLLFL

SEQ ID NO: 2075 - protein, 9 aa, BORRELIA OppA
LQKSLLFLI

SEQ ID NO: 2076 - protein, 9 aa, BORRELIA OppA
QKSLLFLII

SEQ ID NO: 2077 - protein, 9 aa, BORRELIA OppA
KSLLFLIIF

SEQ ID NO: 2078 - protein, 9 aa, BORRELIA OppA
SLLFLIIFF

SEQ ID NO: 2079 - protein, 9 aa, BORRELIA OppA
SSDGTVYTF

SEQ ID NO: 2080 - protein, 9 aa, BORRELIA OppA
ITWSDGVPI

SEQ ID NO: 2081 - protein, 9 aa, BORRELIA OppA
RIPNEKYVF

SEQ ID NO: 2082 - protein, 9 aa, BORRELIA OppA
YVFEKNDKY

SEQ ID NO: 2083 - protein, 9 aa, BORRELIA OppA
DKYYNSSEV

SEQ ID NO: 2084 - protein, 9 aa, BORRELIA OppA
VEVQEIAFY

SEQ ID NO: 2085 - protein, 9 aa, BORRELIA OppA
YKMYENEEL

SEQ ID NO: 2086 - protein, 9 aa, BORRELIA OppA
AIDRETLAY

SEQ ID NO: 2087 - protein, 9 aa, BORRELIA OppA
TKANGNYEI

SEQ ID NO: 2088 - protein, 9 aa, BORRELIA OppA
MKLQRSLFL

SEQ ID NO: 2089 - protein, 9 aa, BORRELIA OppA
LQRSLFLII

SEQ ID NO: 2090 - protein, 9 aa, BORRELIA OppA
QRSLFLIIF

SEQ ID NO: 2091 - protein, 9 aa, BORRELIA OppA
RSLFLIIFF

SEQ ID NO: 2092 - protein, 9 aa, BORRELIA OppA
KERKEGVSF

SEQ ID NO: 2093 - protein, 9 aa, BORRELIA OppA
YTFNLREKI

SEQ ID NO: 2094 - protein, 9 aa, BORRELIA OppA
SVIKNGQKY

SEQ ID NO: 2095 - protein, 9 aa, BORRELIA OppA
VIKNGQKYF

SEQ ID NO: 2096 - protein, 9 aa, BORRELIA OppA
QKYFDGQVT

SEQ ID NO: 2097 - protein, 9 aa, BORRELIA OppA
LVHQSFIPV

SEQ ID NO: 2098 - protein, 9 aa, BORRELIA OppA
HQSFIPVPV

SEQ ID NO: 2099 - protein, 9 aa, BORRELIA OppA
QSFIPVPVH

SEQ ID NO: 2100 - protein, 9 aa, BORRELIA OppA
QNWTSPENM

SEQ ID NO: 2101 - protein, 9 aa, BORRELIA OppA
YVFEKNNKY

SEQ ID NO: 2102 - protein, 9 aa, BORRELIA OppA
NKYYDSNEV

SEQ ID NO: 2103 - protein, 9 aa, BORRELIA OppA
VELEEITFY

SEQ ID NO: 2104 - protein, 9 aa, BORRELIA OppA
KNLKLRSDY

SEQ ID NO: 2105 - protein, 9 aa, BORRELIA OppA
IKPLDNVKI

SEQ ID NO: 2106 - protein, 9 aa, BORRELIA OppA
VKIRKALTL

SEQ ID NO: 2107 - protein, 9 aa, BORRELIA OppA
IRKALTLAI

SEQ ID NO: 2108 - protein, 9 aa, BORRELIA OppA
FSSYSYAKS

SEQ ID NO: 2109 - protein, 9 aa, BORRELIA OppA
SSYSYAKSL

SEQ ID NO: 2110 - protein, 9 aa, BORRELIA OppA
YSYAKSLEL

SEQ ID NO: 2111 - protein, 9 aa, BORRELIA OppA
SYAKSLELF

SEQ ID NO: 2112 - protein, 9 aa, BORRELIA OppA
LKYNTNEAN

SEQ ID NO: 2113 - protein, 9 aa, BORRELIA OppA
EANKKICEF

SEQ ID NO: 2114 - protein, 9 aa, BORRELIA OppA
SHNYSNPEY

SEQ ID NO: 2115 - protein, 9 aa, BORRELIA OppA
YSNPEYNEL

SEQ ID NO: 2116 - protein, 9 aa, BORRELIA OppA
MKSQSRTNF

SEQ ID NO: 2117 - protein, 9 aa, BORRELIA OppA
SQSRTNFTL

SEQ ID NO: 2118 - protein, 9 aa, BORRELIA OppA
SRTNFTLSL

SEQ ID NO: 2119 - protein, 9 aa, BORRELIA OppA
TQLAEKQEL

SEQ ID NO: 2120 - protein, 9 aa, BORRELIA OppA
HKVESDVEF

SEQ ID NO: 2121 - protein, 9 aa, BORRELIA OppA
NKDNTVWTF

SEQ ID NO: 2122 - protein, 9 aa, BORRELIA OppA
FHLRPGITW

SEQ ID NO: 2123 - protein, 9 aa, BORRELIA OppA
ITWSDGTAI

SEQ ID NO: 2124 - protein, 9 aa, BORRELIA OppA
VDPKTASPY

SEQ ID NO: 2125 - protein, 9 aa, BORRELIA OppA
KTASPYASY

SEQ ID NO: 2126 - protein, 9 aa, BORRELIA OppA
YASYPGNMH

SEQ ID NO: 2127 - protein, 9 aa, BORRELIA OppA
ASYPGNMHI

SEQ ID NO: 2128 - protein, 9 aa, BORRELIA OppA
MHIVNGAAI

SEQ ID NO: 2129 - protein, 9 aa, BORRELIA OppA
KQAPDTLGV

SEQ ID NO: 2130 - protein, 9 aa, BORRELIA OppA
VKALNDTTL

SEQ ID NO: 2131 - protein, 9 aa, BORRELIA OppA
TLTQPNAAF

SEQ ID NO: 2132 - protein, 9 aa, BORRELIA OppA
LTQPNAAFL

SEQ ID NO: 2133 - protein, 9 aa, BORRELIA OppA
LAMLAHPSM

SEQ ID NO: 2134 - protein, 9 aa, BORRELIA OppA
AMLAHPSMV

SEQ ID NO: 2135 - protein, 9 aa, BORRELIA OppA
LAHPSMVPV

SEQ ID NO: 2136 - protein, 9 aa, BORRELIA OppA
SMVPVDKVL

SEQ ID NO: 2137 - protein, 9 aa, BORRELIA OppA
EKWTKPEHL

SEQ ID NO: 2138 - protein, 9 aa, BORRELIA OppA
EHLVTSGAY

SEQ ID NO: 2139 - protein, 9 aa, BORRELIA OppA
YKLSQWVVN

SEQ ID NO: 2140 - protein, 9 aa, BORRELIA OppA
SQWVVNERI

SEQ ID NO: 2141 - protein, 9 aa, BORRELIA OppA
HTVINKVTY

SEQ ID NO: 2142 - protein, 9 aa, BORRELIA OppA
INKVTYLPI

SEQ ID NO: 2143 - protein, 9 aa, BORRELIA OppA
KAGEIDIVY

SEQ ID NO: 2144 - protein, 9 aa, BORRELIA OppA
VYTVPINQF

SEQ ID NO: 2145 - protein, 9 aa, BORRELIA OppA
LKKTMGTQL

SEQ ID NO: 2146 - protein, 9 aa, BORRELIA OppA
TQLDVSPQL

SEQ ID NO: 2147 - protein, 9 aa, BORRELIA OppA
VSPQLATYY

SEQ ID NO: 2148 - protein, 9 aa, BORRELIA OppA
QLATYYYEF

SEQ ID NO: 2149 - protein, 9 aa, BORRELIA OppA
VRKALNMAL

SEQ ID NO: 2150 - protein, 9 aa, BORRELIA OppA
LKTPDYASW

SEQ ID NO: 2151 - protein, 9 aa, BORRELIA OppA
KKLLEEAGF

SEQ ID NO: 2152 - protein, 9 aa, BORRELIA OppA
AGFNASHPL

SEQ ID NO: 2153 - protein, 9 aa, BORRELIA OppA
FNASHPLSF

SEQ ID NO: 2154 - protein, 9 aa, BORRELIA OppA
LLYNTSESH

SEQ ID NO: 2155 - protein, 9 aa, BORRELIA OppA
RIAIAASSM

SEQ ID NO: 2156 - protein, 9 aa, BORRELIA OppA
SMWKKNLGV

SEQ ID NO: 2157 - protein, 9 aa, BORRELIA OppA
LQNQEWKTM

SEQ ID NO: 2158 - protein, 9 aa, BORRELIA OppA
TMLDTMHTH

SEQ ID NO: 2159 - protein, 9 aa, BORRELIA OppA
LDTMHTHNF

SEQ ID NO: 2160 - protein, 9 aa, BORRELIA OppA
MHTHNFDAV

SEQ ID NO: 2161 - protein, 9 aa, BORRELIA OppA
VRYAWIADY

SEQ ID NO: 2162 - protein, 9 aa, BORRELIA OppA
ADYDDAATF

SEQ ID NO: 2163 - protein, 9 aa, BORRELIA OppA
TSQYSNPDY

SEQ ID NO: 2164 - protein, 9 aa, BORRELIA OppA
SQYSNPDYD

SEQ ID NO: 2165 - protein, 9 aa, BORRELIA OppA
KTTQERGQF

SEQ ID NO: 2166 - protein, 9 aa, BORRELIA OppA
TTQERGQFY

SEQ ID NO: 2167 - protein, 9 aa, BORRELIA OppA
RDVPAIPVY

SEQ ID NO: 2168 - protein, 9 aa, BORRELIA OppA
LGYYYTKDM

SEQ ID NO: 2169 - protein, 9 aa, BORRELIA OppA
GYYYTKDMY

SEQ ID NO: 2170 - protein, 9 aa, BORRELIA OppA
YYYTKDMYI

SEQ ID NO: 2171 - protein, 10 aa, BORRELIA OppA
LQKLLFLIIF

SEQ ID NO: 2172 - protein, 10 aa, BORRELIA OppA
LFLIIFFLTF

SEQ ID NO: 2173 - protein, 10 aa, BORRELIA OppA
KSTIKNGQKY

SEQ ID NO: 2174 - protein, 10 aa, BORRELIA OppA
RRITPNFSSY

SEQ ID NO: 2175 - protein, 10 aa, BORRELIA OppA
YSYAKNLELF

SEQ ID NO: 2176 - protein, 10 aa, BORRELIA OppA
SSHNYSSPEY

SEQ ID NO: 2177 - protein, 10 aa, BORRELIA OppA
SIFTHGYTQF

SEQ ID NO: 2178 - protein, 10 aa, BORRELIA OppA
LQKLLFSVIF

SEQ ID NO: 2179 - protein, 10 aa, BORRELIA OppA
QKLLFSVIFF

SEQ ID NO: 2180 - protein, 10 aa, BORRELIA OppA
LFSVIFFLTF

SEQ ID NO: 2181 - protein, 10 aa, BORRELIA OppA
FSVIFFLTFL

SEQ ID NO: 2182 - protein, 10 aa, BORRELIA OppA
RRIAPNFSSY

SEQ ID NO: 2183 - protein, 10 aa, BORRELIA OppA
LQKSLFLIIF

SEQ ID NO: 2184 - protein, 10 aa, BORRELIA OppA
KEKAKEGVSF

SEQ ID NO: 2185 - protein, 10 aa, BORRELIA OppA
KSAIKNGQKY

SEQ ID NO: 2186 - protein, 10 aa, BORRELIA OppA
SAIKNGQKYF

SEQ ID NO: 2187 - protein, 10 aa, BORRELIA OppA
RRATPNFSSY

SEQ ID NO: 2188 - protein, 10 aa, BORRELIA OppA
SSHNYSNSEY

SEQ ID NO: 2189 - protein, 10 aa, BORRELIA OppA
QKSLLFLIIF

SEQ ID NO: 2190 - protein, 10 aa, BORRELIA OppA
LQRSLFLIIF

SEQ ID NO: 2191 - protein, 10 aa, BORRELIA OppA
NKERKEGVSF

SEQ ID NO: 2192 - protein, 10 aa, BORRELIA OppA
KSVIKNGQKY

SEQ ID NO: 2193 - protein, 10 aa, BORRELIA OppA
YSYAKSLELF

SEQ ID NO: 2194 - protein, 10 aa, BORRELIA OppA
SSHNYSNPEY

SEQ ID NO: 2195 - protein, 10 aa, BORRELIA OppA
PKTASPYASY

SEQ ID NO: 2196 - protein, 10 aa, BORRELIA OppA
PQLATYYYEF

SEQ ID NO: 2197 - protein, 10 aa, BORRELIA OppA
YEFNTTRPPF

SEQ ID NO: 2198 - protein, 10 aa, BORRELIA OppA
IADYDDAATF

SEQ ID NO: 2199 - protein, 11 aa, BORRELIA OppA
LQKLLFLIIFF

SEQ ID NO: 2200 - protein, 11 aa, BORRELIA OppA
LLFLIIFFLTF

SEQ ID NO: 2201 - protein, 11 aa, BORRELIA OppA
KLQKLLFSVIF

SEQ ID NO: 2202 - protein, 11 aa, BORRELIA OppA
LQKLLFSVIFF

SEQ ID NO: 2203 - protein, 11 aa, BORRELIA OppA
LLFSVIFFLTF

SEQ ID NO: 2204 - protein, 11 aa, BORRELIA OppA
KLQKSLFLIIF

SEQ ID NO: 2205 - protein, 11 aa, BORRELIA OppA
LQKSLFLIIFF

SEQ ID NO: 2206 - protein, 11 aa, BORRELIA OppA
SKEKAKEGVSF

SEQ ID NO: 2207 - protein, 11 aa, BORRELIA OppA
LQKSLLFLIIF

SEQ ID NO: 2208 - protein, 11 aa, BORRELIA OppA
KLQRSLFLIIF

SEQ ID NO: 2209 - protein, 11 aa, BORRELIA OppA
LQRSLFLIIFF

SEQ ID NO: 2210 - protein, 11 aa, BORRELIA OppA
YYEFNTTRPPF

SEQ ID NO: 2211 - protein, 12 aa, BORRELIA OppA
KMYENGELDAIF

SEQ ID NO: 2212 - protein, 12 aa, BORRELIA OppA
MKLQKLLFSVIF

SEQ ID NO: 2213 - protein, 12 aa, BORRELIA OppA
KLQKLLFSVIFF

SEQ ID NO: 2214 - protein, 12 aa, BORRELIA OppA
LQKLLFSVIFFL

SEQ ID NO: 2215 - protein, 12 aa, BORRELIA OppA
KLLFSVIFFLTF

SEQ ID NO: 2216 - protein, 12 aa, BORRELIA OppA
LLFSVIFFLTFL

SEQ ID NO: 2217 - protein, 12 aa, BORRELIA OppA
KMYENKELDAIF

SEQ ID NO: 2218 - protein, 12 aa, BORRELIA OppA
MKLQKSLFLIIF

SEQ ID NO: 2219 - protein, 12 aa, BORRELIA OppA
KLQKSLFLIIFF

SEQ ID NO: 2220 - protein, 12 aa, BORRELIA OppA
LQKSLFLIIFFL

SEQ ID NO: 2221 - protein, 12 aa, BORRELIA OppA
KSWNISPDGTVY

SEQ ID NO: 2222 - protein, 12 aa, BORRELIA OppA
KLQKSLLFLIIF

SEQ ID NO: 2223 - protein, 12 aa, BORRELIA OppA
LQKSLLFLIIFF

SEQ ID NO: 2224 - protein, 12 aa, BORRELIA OppA
KSWDISSDGTVY

SEQ ID NO: 2225 - protein, 12 aa, BORRELIA OppA
KMYENEELDAIF

SEQ ID NO: 2226 - protein, 12 aa, BORRELIA OppA
MKLQRSLFLIIF

SEQ ID NO: 2227 - protein, 12 aa, BORRELIA OppA
KLQRSLFLIIFF

SEQ ID NO: 2228 - protein, 12 aa, BORRELIA OppA
LQRSLFLIIFFL

SEQ ID NO: 2229 - protein, 12 aa, BORRELIA OppA
RSLFLIIFFLTF

SEQ ID NO: 2230 - protein, 12 aa, BORRELIA OppA
SSYSYAKSLELF

SEQ ID NO: 2231 - protein, 12 aa, BORRELIA OppA
YYYEFNTTRPPF

SEQ ID NO: 2232 - protein, 12 aa, BORRELIA OppA
SQYSNPDYDQAL

SEQ ID NO: 2233 - protein, 12 aa, BORRELIA OppA
AKAKTTQERGQF

SEQ ID NO: 2234 - protein, 9 aa, BORRELIA OppA
EEKKEGVSF

SEQ ID NO: 2235 - protein, 9 aa, BORRELIA OppA
DEKTLEITL

SEQ ID NO: 2236 - protein, 9 aa, BORRELIA OppA
IDMLVHQSF

SEQ ID NO: 2237 - protein, 9 aa, BORRELIA OppA
VEVQEITFY

SEQ ID NO: 2238 - protein, 9 aa, BORRELIA OppA
GELDAIFSA

SEQ ID NO: 2239 - protein, 9 aa, BORRELIA OppA
TPNFSSYSY

SEQ ID NO: 2240 - protein, 9 aa, BORRELIA OppA
LENEEWTTY

SEQ ID NO: 2241 - protein, 9 aa, BORRELIA OppA
NEEWTTYLN

SEQ ID NO: 2242 - protein, 9 aa, BORRELIA OppA
DPLTFLSIF

SEQ ID NO: 2243 - protein, 9 aa, BORRELIA OppA
EEKKEGISF

SEQ ID NO: 2244 - protein, 9 aa, BORRELIA OppA
IYFYAFNTY

SEQ ID NO: 2245 - protein, 9 aa, BORRELIA OppA
DPATFLSIF

SEQ ID NO: 2246 - protein, 9 aa, BORRELIA OppA
VEVQEIAFY

SEQ ID NO: 2247 - protein, 9 aa, BORRELIA OppA
YENEELDAI

SEQ ID NO: 2248 - protein, 9 aa, BORRELIA OppA
EELDAIFGS

SEQ ID NO: 2249 - protein, 9 aa, BORRELIA OppA
KERKEGVSF

SEQ ID NO: 2250 - protein, 9 aa, BORRELIA OppA
VELEEITFY

SEQ ID NO: 2251 - protein, 9 aa, BORRELIA OppA
VEFNILSDL

SEQ ID NO: 2252 - protein, 9 aa, BORRELIA OppA
WENKDNTVW

SEQ ID NO: 2253 - protein, 9 aa, BORRELIA OppA
GEIDIVYTV

SEQ ID NO: 2254 - protein, 9 aa, BORRELIA OppA
YEFNTTRPP

SEQ ID NO: 2255 - protein, 9 aa, BORRELIA OppA
EEAGFNASH

SEQ ID NO: 2256 - protein, 10 aa, BORRELIA OppA
YENGELDAIF

SEQ ID NO: 2257 - protein, 10 aa, BORRELIA OppA
NGELDAIFSA

SEQ ID NO: 2258 - protein, 10 aa, BORRELIA OppA
ELENEEWTTY

SEQ ID NO: 2259 - protein, 10 aa, BORRELIA OppA
YENKELDAIF

SEQ ID NO: 2260 - protein, 10 aa, BORRELIA OppA
NEVEVQEITF

SEQ ID NO: 2261 - protein, 10 aa, BORRELIA OppA
SEVEVQEIAF

SEQ ID NO: 2262 - protein, 10 aa, BORRELIA OppA
YENEELDAIF

SEQ ID NO: 2263 - protein, 10 aa, BORRELIA OppA
NEVELEEITF

SEQ ID NO: 2264 - protein, 10 aa, BORRELIA OppA
EVELEEITFY

SEQ ID NO: 2265 - protein, 10 aa, BORRELIA OppA
VEFNILSDLF

SEQ ID NO: 2266 - protein, 10 aa, BORRELIA OppA
YEFNTTRPPF

SEQ ID NO: 2267 - protein, 10 aa, BORRELIA OppA
QEWKTMLDTM

SEQ ID NO: 2268 - protein, 11 aa, BORRELIA OppA
LEITLESPKPY

SEQ ID NO: 2269 - protein, 11 aa, BORRELIA OppA
MYENGELDAIF

SEQ ID NO: 2270 - protein, 11 aa, BORRELIA OppA
YENGELDAIFS

SEQ ID NO: 2271 - protein, 11 aa, BORRELIA OppA
VELENEEWTTY

SEQ ID NO: 2272 - protein, 11 aa, BORRELIA OppA
IEKDFPIAPIY

SEQ ID NO: 2273 - protein, 11 aa, BORRELIA OppA
MYENKELDAIF

SEQ ID NO: 2274 - protein, 11 aa, BORRELIA OppA
YENKELDAIFG

SEQ ID NO: 2275 - protein, 11 aa, BORRELIA OppA
SNEVEVQEITF

SEQ ID NO: 2276 - protein, 11 aa, BORRELIA OppA
NEVEVQEITFY

SEQ ID NO: 2277 - protein, 11 aa, BORRELIA OppA
YENKELDAIFV

SEQ ID NO: 2278 - protein, 11 aa, BORRELIA OppA
SSEVEVQEIAF

SEQ ID NO: 2279 - protein, 11 aa, BORRELIA OppA
SEVEVQEIAFY

SEQ ID NO: 2280 - protein, 11 aa, BORRELIA OppA
MYENEELDAIF

SEQ ID NO: 2281 - protein, 11 aa, BORRELIA OppA
YENEELDAIFG

SEQ ID NO: 2282 - protein, 11 aa, BORRELIA OppA
SNEVELEEITF

SEQ ID NO: 2283 - protein, 11 aa, BORRELIA OppA
NEVELEEITFY

SEQ ID NO: 2284 - protein, 11 aa, BORRELIA OppA
WENKDNTVWTF

SEQ ID NO: 2285 - protein, 11 aa, BORRELIA OppA
YYEFNTTRPPF

SEQ ID NO: 2286 - protein, 11 aa, BORRELIA OppA
YEFNTTRPPFN

SEQ ID NO: 2287 - protein, 12 aa, BORRELIA OppA
TLEITLESPKPY

SEQ ID NO: 2288 - protein, 12 aa, BORRELIA OppA
KMYENGELDAIF

SEQ ID NO: 2289 - protein, 12 aa, BORRELIA OppA
YENGELDAIFSA

SEQ ID NO: 2290 - protein, 12 aa, BORRELIA OppA
DVELENEEWTTY

SEQ ID NO: 2291 - protein, 12 aa, BORRELIA OppA
IIEKDFPIAPIY

SEQ ID NO: 2292 - protein, 12 aa, BORRELIA OppA
IEKDFPIAPIYI

SEQ ID NO: 2293 - protein, 12 aa, BORRELIA OppA
KMYENKELDAIF

SEQ ID NO: 2294 - protein, 12 aa, BORRELIA OppA
NSNEVEVQEITF

SEQ ID NO: 2295 - protein, 12 aa, BORRELIA OppA
SNEVEVQEITFY

SEQ ID NO: 2296 - protein, 12 aa, BORRELIA OppA
NEVEVQEITFYT

SEQ ID NO: 2297 - protein, 12 aa, BORRELIA OppA
NSSEVEVQEIAF

SEQ ID NO: 2298 - protein, 12 aa, BORRELIA OppA
SSEVEVQEIAFY

SEQ ID NO: 2299 - protein, 12 aa, BORRELIA OppA
KMYENEELDAIF

SEQ ID NO: 2300 - protein, 12 aa, BORRELIA OppA
MYENEELDAIFG

SEQ ID NO: 2301 - protein, 12 aa, BORRELIA OppA
DSNEVELEEITF

SEQ ID NO: 2302 - protein, 12 aa, BORRELIA OppA
SNEVELEEITFY

SEQ ID NO: 2303 - protein, 12 aa, BORRELIA OppA
NEVELEEITFYT

SEQ ID NO: 2304 - protein, 12 aa, BORRELIA OppA
KWENKDNTVWTF

SEQ ID NO: 2305 - protein, 12 aa, BORRELIA OppA
WENKDNTVWTFH

SEQ ID NO: 2306 - protein, 12 aa, BORRELIA OppA
LEVTLTQPNAAF

SEQ ID NO: 2307 - protein, 12 aa, BORRELIA OppA
YYYEFNTTRPPF

SEQ ID NO: 2308 - protein, 12 aa, BORRELIA OppA
YYEFNTTRPPFN

SEQ ID NO: 2309 - protein, 12 aa, BORRELIA OppA
YEFNTTRPPFND

SEQ ID NO: 2310 - protein, 9 aa, BORRELIA OppA
FLIIFFLTF

SEQ ID NO: 2311 - protein, 9 aa, BORRELIA OppA
EPSSLDPQL

SEQ ID NO: 2312 - protein, 9 aa, BORRELIA OppA
DISPDGTVY

SEQ ID NO: 2313 - protein, 9 aa, BORRELIA OppA
SPDGTVYTF

SEQ ID NO: 2314 - protein, 9 aa, BORRELIA OppA
TAEGIRKSY

SEQ ID NO: 2315 - protein, 9 aa, BORRELIA OppA
ITLESPKPY

SEQ ID NO: 2316 - protein, 9 aa, BORRELIA OppA
SPKPYFIDM

SEQ ID NO: 2317 - protein, 9 aa, BORRELIA OppA
IPIPIHIAE

SEQ ID NO: 2318 - protein, 9 aa, BORRELIA OppA
IPIHIAEKY

SEQ ID NO: 2319 - protein, 9 aa, BORRELIA OppA
YVVEKNDKY

SEQ ID NO: 2320 - protein, 9 aa, BORRELIA OppA
QVEVQEITF

SEQ ID NO: 2321 - protein, 9 aa, BORRELIA OppA
TTNDNSTAY

SEQ ID NO: 2322 - protein, 9 aa, BORRELIA OppA
YSSAVNAIY

SEQ ID NO: 2323 - protein, 9 aa, BORRELIA OppA
SAVNAIYFY

SEQ ID NO: 2324 - protein, 9 aa, BORRELIA OppA
RITPNFSSY

SEQ ID NO: 2325 - protein, 9 aa, BORRELIA OppA
TPNFSSYSY

SEQ ID NO: 2326 - protein, 9 aa, BORRELIA OppA
YPNGNGFPI

SEQ ID NO: 2327 - protein, 9 aa, BORRELIA OppA
EAHKKICEF

SEQ ID NO: 2328 - protein, 9 aa, BORRELIA OppA
LENEEWTTY

SEQ ID NO: 2329 - protein, 9 aa, BORRELIA OppA
YADPLTFLS

SEQ ID NO: 2330 - protein, 9 aa, BORRELIA OppA
DPLTFLSIF

SEQ ID NO: 2331 - protein, 9 aa, BORRELIA OppA
FLSIFTQGY

SEQ ID NO: 2332 - protein, 9 aa, BORRELIA OppA
YTQFSSHNY

SEQ ID NO: 2333 - protein, 9 aa, BORRELIA OppA
FPIAPIYIY

SEQ ID NO: 2334 - protein, 9 aa, BORRELIA OppA
YIYGNSYLF

SEQ ID NO: 2335 - protein, 9 aa, BORRELIA OppA
FLSILTHGY

SEQ ID NO: 2336 - protein, 9 aa, BORRELIA OppA
FLSIFTHGY

SEQ ID NO: 2337 - protein, 9 aa, BORRELIA OppA
FSVIFFLTF

SEQ ID NO: 2338 - protein, 9 aa, BORRELIA OppA
TTNDSSTAY

SEQ ID NO: 2339 - protein, 9 aa, BORRELIA OppA
IYFYAFNTY

SEQ ID NO: 2340 - protein, 9 aa, BORRELIA OppA
RIAPNFSSY

SEQ ID NO: 2341 - protein, 9 aa, BORRELIA OppA
APNFSSYSY

SEQ ID NO: 2342 - protein, 9 aa, BORRELIA OppA
VASKMIDTM

SEQ ID NO: 2343 - protein, 9 aa, BORRELIA OppA
NISPDGTVY

SEQ ID NO: 2344 - protein, 9 aa, BORRELIA OppA
SAIKNGQKY

SEQ ID NO: 2345 - protein, 9 aa, BORRELIA OppA
IPIPIHVTE

SEQ ID NO: 2346 - protein, 9 aa, BORRELIA OppA
IPIHVTEKY

SEQ ID NO: 2347 - protein, 9 aa, BORRELIA OppA
MVTSGPFKL

SEQ ID NO: 2348 - protein, 9 aa, BORRELIA OppA
EVEVQEITF

SEQ ID NO: 2349 - protein, 9 aa, BORRELIA OppA
RATPNFSSY

SEQ ID NO: 2350 - protein, 9 aa, BORRELIA OppA
YADPATFLS

SEQ ID NO: 2351 - protein, 9 aa, BORRELIA OppA
DPATFLSIF

SEQ ID NO: 2352 - protein, 9 aa, BORRELIA OppA
YSNSEYNEL

SEQ ID NO: 2353 - protein, 9 aa, BORRELIA OppA
DISSDGTVY

SEQ ID NO: 2354 - protein, 9 aa, BORRELIA OppA
SSDGTVYTF

SEQ ID NO: 2355 - protein, 9 aa, BORRELIA OppA
YVFEKNDKY

SEQ ID NO: 2356 - protein, 9 aa, BORRELIA OppA
EVEVQEIAF

SEQ ID NO: 2357 - protein, 9 aa, BORRELIA OppA
AIDRETLAY

SEQ ID NO: 2358 - protein, 9 aa, BORRELIA OppA
IPVPVHVTE

SEQ ID NO: 2359 - protein, 9 aa, BORRELIA OppA
VPVHVTEKY

SEQ ID NO: 2360 - protein, 9 aa, BORRELIA OppA
YVFEKNNKY

SEQ ID NO: 2361 - protein, 9 aa, BORRELIA OppA
EVELEEITF

SEQ ID NO: 2362 - protein, 9 aa, BORRELIA OppA
YSYAKSLEL

SEQ ID NO: 2363 - protein, 9 aa, BORRELIA OppA
EANKKICEF

SEQ ID NO: 2364 - protein, 9 aa, BORRELIA OppA
YSNPEYNEL

SEQ ID NO: 2365 - protein, 9 aa, BORRELIA OppA
CASAASQAA

SEQ ID NO: 2366 - protein, 9 aa, BORRELIA OppA
VPAGTQLAE

SEQ ID NO: 2367 - protein, 9 aa, BORRELIA OppA
HKVESDVEF

SEQ ID NO: 2368 - protein, 9 aa, BORRELIA OppA
YASYPGNMH

SEQ ID NO: 2369 - protein, 9 aa, BORRELIA OppA
YPGNMHIVN

SEQ ID NO: 2370 - protein, 9 aa, BORRELIA OppA
TLTQPNAAF

SEQ ID NO: 2371 - protein, 9 aa, BORRELIA OppA
QPNAAFLAM

SEQ ID NO: 2372 - protein, 9 aa, BORRELIA OppA
AAFLAMLAH

SEQ ID NO: 2373 - protein, 9 aa, BORRELIA OppA
LAMLAHPSM

SEQ ID NO: 2374 - protein, 9 aa, BORRELIA OppA
LAHPSMVPV

SEQ ID NO: 2375 - protein, 9 aa, BORRELIA OppA
IVAERNPRY

SEQ ID NO: 2376 - protein, 9 aa, BORRELIA OppA
NPRYWDNAH

SEQ ID NO: 2377 - protein, 9 aa, BORRELIA OppA
HTVINKVTY

SEQ ID NO: 2378 - protein, 9 aa, BORRELIA OppA
LPITSEAAD

SEQ ID NO: 2379 - protein, 9 aa, BORRELIA OppA
KAGEIDIVY

SEQ ID NO: 2380 - protein, 9 aa, BORRELIA OppA
VPINQFAQL

SEQ ID NO: 2381 - protein, 9 aa, BORRELIA OppA
DVSPQLATY

SEQ ID NO: 2382 - protein, 9 aa, BORRELIA OppA
SPQLATYYY

SEQ ID NO: 2383 - protein, 9 aa, BORRELIA OppA
MALDKDIIA

SEQ ID NO: 2384 - protein, 9 aa, BORRELIA OppA
QPDIGGVTL

SEQ ID NO: 2385 - protein, 9 aa, BORRELIA OppA
TPDYASWPM

SEQ ID NO: 2386 - protein, 9 aa, BORRELIA OppA
WPMDKRIAE

SEQ ID NO: 2387 - protein, 9 aa, BORRELIA OppA
FNASHPLSF

SEQ ID NO: 2388 - protein, 9 aa, BORRELIA OppA
HPLSFNLLY

SEQ ID NO: 2389 - protein, 9 aa, BORRELIA OppA
IAIAASSMW

SEQ ID NO: 2390 - protein, 9 aa, BORRELIA OppA
WIADYDDAA

SEQ ID NO: 2391 - protein, 9 aa, BORRELIA OppA
IADYDDAAT

SEQ ID NO: 2392 - protein, 9 aa, BORRELIA OppA
DAATFLNNF

SEQ ID NO: 2393 - protein, 9 aa, BORRELIA OppA
VPAIPVYHY

SEQ ID NO: 2394 - protein, 9 aa, BORRELIA OppA
TPDKLGYYY

SEQ ID NO: 2395 - protein, 10 aa, BORRELIA OppA
ISPDGTVYTF

SEQ ID NO: 2396 - protein, 10 aa, BORRELIA OppA
FIPIPIHIAE

SEQ ID NO: 2397 - protein, 10 aa, BORRELIA OppA
YTTNDNSTAY

SEQ ID NO: 2398 - protein, 10 aa, BORRELIA OppA
YYSSAVNAIY

SEQ ID NO: 2399 - protein, 10 aa, BORRELIA OppA
YAFNTHIKPL

SEQ ID NO: 2400 - protein, 10 aa, BORRELIA OppA
LAIDRETLTY

SEQ ID NO: 2401 - protein, 10 aa, BORRELIA OppA
ITPNFSSYSY

SEQ ID NO: 2402 - protein, 10 aa, BORRELIA OppA
TPNFSSYSYA

SEQ ID NO: 2403 - protein, 10 aa, BORRELIA OppA
YPNGNGFPIL

SEQ ID NO: 2404 - protein, 10 aa, BORRELIA OppA
DFPIAPIYIY

SEQ ID NO: 2405 - protein, 10 aa, BORRELIA OppA
FPIAPIYIYG

SEQ ID NO: 2406 - protein, 10 aa, BORRELIA OppA
APIYIYGNSY

SEQ ID NO: 2407 - protein, 10 aa, BORRELIA OppA
YTTNDSSTAY

SEQ ID NO: 2408 - protein, 10 aa, BORRELIA OppA
YAFNTYIKPL

SEQ ID NO: 2409 - protein, 10 aa, BORRELIA OppA
IAPNFSSYSY

SEQ ID NO: 2410 - protein, 10 aa, BORRELIA OppA
APNFSSYSYA

SEQ ID NO: 2411 - protein, 10 aa, BORRELIA OppA
YAFNTTVKPL

SEQ ID NO: 2412 - protein, 10 aa, BORRELIA OppA
ATPNFSSYSY

SEQ ID NO: 2413 - protein, 10 aa, BORRELIA OppA
WDISSDGTVY

SEQ ID NO: 2414 - protein, 10 aa, BORRELIA OppA
YVFEKNDKYY

SEQ ID NO: 2415 - protein, 10 aa, BORRELIA OppA
LAIDRETLAY

SEQ ID NO: 2416 - protein, 10 aa, BORRELIA OppA
LVDPKTASPY

SEQ ID NO: 2417 - protein, 10 aa, BORRELIA OppA
TQPNAAFLAM

SEQ ID NO: 2418 - protein, 10 aa, BORRELIA OppA
QPNAAFLAML

SEQ ID NO: 2419 - protein, 10 aa, BORRELIA OppA
FLAMLAHPSM

SEQ ID NO: 2420 - protein, 10 aa, BORRELIA OppA
YKAGEIDIVY

SEQ ID NO: 2421 - protein, 10 aa, BORRELIA OppA
VSPQLATYYY

SEQ ID NO: 2422 - protein, 10 aa, BORRELIA OppA
KTPDYASWPM

SEQ ID NO: 2423 - protein, 10 aa, BORRELIA OppA
TPDYASWPMD

SEQ ID NO: 2424 - protein, 10 aa, BORRELIA OppA
SHPLSFNLLY

SEQ ID NO: 2425 - protein, 10 aa, BORRELIA OppA
HPLSFNLLYN

SEQ ID NO: 2426 - protein, 10 aa, BORRELIA OppA
IADYDDAATF

SEQ ID NO: 2427 - protein, 10 aa, BORRELIA OppA
FTPDKLGYYY

SEQ ID NO: 2428 - protein, 11 aa, BORRELIA OppA
IPIPIHIAEKY

SEQ ID NO: 2429 - protein, 11 aa, BORRELIA OppA
FYTTNDNSTAY

SEQ ID NO: 2430 - protein, 11 aa, BORRELIA OppA
TLAIDRETLTY

SEQ ID NO: 2431 - protein, 11 aa, BORRELIA OppA
LAIDRETLTYK

SEQ ID NO: 2432 - protein, 11 aa, BORRELIA OppA
RITPNFSSYSY

SEQ ID NO: 2433 - protein, 11 aa, BORRELIA OppA
ITPNFSSYSYA

SEQ ID NO: 2434 - protein, 11 aa, BORRELIA OppA
YADPLTFLSIF

SEQ ID NO: 2435 - protein, 11 aa, BORRELIA OppA
KDFPIAPIYIY

SEQ ID NO: 2436 - protein, 11 aa, BORRELIA OppA
FPIAPIYIYGN

SEQ ID NO: 2437 - protein, 11 aa, BORRELIA OppA
FYTTNDSSTAY

SEQ ID NO: 2438 - protein, 11 aa, BORRELIA OppA
RIAPNFSSYSY

SEQ ID NO: 2439 - protein, 11 aa, BORRELIA OppA
IAPNFSSYSYA

SEQ ID NO: 2440 - protein, 11 aa, BORRELIA OppA
IPIPIHVTEKY

SEQ ID NO: 2441 - protein, 11 aa, BORRELIA OppA
RATPNFSSYSY

SEQ ID NO: 2442 - protein, 11 aa, BORRELIA OppA
YADPATFLSIF

SEQ ID NO: 2443 - protein, 11 aa, BORRELIA OppA
TLAIDRETLAY

SEQ ID NO: 2444 - protein, 11 aa, BORRELIA OppA
LAIDRETLAYK

SEQ ID NO: 2445 - protein, 11 aa, BORRELIA OppA
IPVPVHVTEKY

SEQ ID NO: 2446 - protein, 11 aa, BORRELIA OppA
LTQPNAAFLAM

SEQ ID NO: 2447 - protein, 11 aa, BORRELIA OppA
LKTPDYASWPM

SEQ ID NO: 2448 - protein, 12 aa, BORRELIA OppA
WDISPDGTVYTF

SEQ ID NO: 2449 - protein, 12 aa, BORRELIA OppA
FIPIPIHIAEKY

SEQ ID NO: 2450 - protein, 12 aa, BORRELIA OppA
IPIPIHIAEKYG

SEQ ID NO: 2451 - protein, 12 aa, BORRELIA OppA
RRITPNFSSYSY

SEQ ID NO: 2452 - protein, 12 aa, BORRELIA OppA
ITPNFSSYSYAK

SEQ ID NO: 2453 - protein, 12 aa, BORRELIA OppA
YPNGNGFPILKL

SEQ ID NO: 2454 - protein, 12 aa, BORRELIA OppA
EKDFPIAPIYIY

SEQ ID NO: 2455 - protein, 12 aa, BORRELIA OppA
FPIAPIYIYGNS

SEQ ID NO: 2456 - protein, 12 aa, BORRELIA OppA
RRIAPNFSSYSY

SEQ ID NO: 2457 - protein, 12 aa, BORRELIA OppA
IAPNFSSYSYAK

SEQ ID NO: 2458 - protein, 12 aa, BORRELIA OppA
WNISPDGTVYTF

SEQ ID NO: 2459 - protein, 12 aa, BORRELIA OppA
FIPIPIHVTEKY

SEQ ID NO: 2460 - protein, 12 aa, BORRELIA OppA
IPIPIHVTEKYG

SEQ ID NO: 2461 - protein, 12 aa, BORRELIA OppA
LTLAIDRETLAY

SEQ ID NO: 2462 - protein, 12 aa, BORRELIA OppA
TLAIDRETLAYK

SEQ ID NO: 2463 - protein, 12 aa, BORRELIA OppA
LAIDRETLAYKV

SEQ ID NO: 2464 - protein, 12 aa, BORRELIA OppA
FIPVPVHVTEKY

SEQ ID NO: 2465 - protein, 12 aa, BORRELIA OppA
IPVPVHVTEKYG

SEQ ID NO: 2466 - protein, 12 aa, BORRELIA OppA
TLTQPNAAFLAM

SEQ ID NO: 2467 - protein, 12 aa, BORRELIA OppA
LTQPNAAFLAML

SEQ ID NO: 2468 - protein, 12 aa, BORRELIA OppA
LDVSPQLATYYY

SEQ ID NO: 2469 - protein, 12 aa, BORRELIA OppA
TLKTPDYASWPM

SEQ ID NO: 2470 - protein, 12 aa, BORRELIA OppA
LKTPDYASWPMD

SEQ ID NO: 2471 - protein, 9 aa, BORRELIA OppA
REKIIWSDG

SEQ ID NO: 2472 - protein, 9 aa, BORRELIA OppA
AEGIRKSYL

SEQ ID NO: 2473 - protein, 9 aa, BORRELIA OppA
KETGSNYSE

SEQ ID NO: 2474 - protein, 9 aa, BORRELIA OppA
LESPKPYFI

SEQ ID NO: 2475 - protein, 9 aa, BORRELIA OppA
YENGELDAI

SEQ ID NO: 2476 - protein, 9 aa, BORRELIA OppA
GELDAIFSA

SEQ ID NO: 2477 - protein, 9 aa, BORRELIA OppA
RETLTYKVL

SEQ ID NO: 2478 - protein, 9 aa, BORRELIA OppA
YEIARAGWI

SEQ ID NO: 2479 - protein, 9 aa, BORRELIA OppA
TERFDLSQL

SEQ ID NO: 2480 - protein, 9 aa, BORRELIA OppA
KETGSNYAE

SEQ ID NO: 2481 - protein, 9 aa, BORRELIA OppA
YENKELDAI

SEQ ID NO: 2482 - protein, 9 aa, BORRELIA OppA
KELDAIFGS

SEQ ID NO: 2483 - protein, 9 aa, BORRELIA OppA
SLFLIIFFL

SEQ ID NO: 2484 - protein, 9 aa, BORRELIA OppA
KELDAIFVS

SEQ ID NO: 2485 - protein, 9 aa, BORRELIA OppA
SERFDLSQL

SEQ ID NO: 2486 - protein, 9 aa, BORRELIA OppA
SEVEVQEIA

SEQ ID NO: 2487 - protein, 9 aa, BORRELIA OppA
QEIAFYTTN

SEQ ID NO: 2488 - protein, 9 aa, BORRELIA OppA
YENEELDAI

SEQ ID NO: 2489 - protein, 9 aa, BORRELIA OppA
RETLAYKVL

SEQ ID NO: 2490 - protein, 9 aa, BORRELIA OppA
KERKEGVSF

SEQ ID NO: 2491 - protein, 9 aa, BORRELIA OppA
LEEITFYTT

SEQ ID NO: 2492 - protein, 9 aa, BORRELIA OppA
LERFDLSQL

SEQ ID NO: 2493 - protein, 9 aa, BORRELIA OppA
VESDVEFNI

SEQ ID NO: 2494 - protein, 9 aa, BORRELIA OppA
VEFNILSDL

SEQ ID NO: 2495 - protein, 9 aa, BORRELIA OppA
FEGLVNVSP

SEQ ID NO: 2496 - protein, 9 aa, BORRELIA OppA
GEIDIVYTV

SEQ ID NO: 2497 - protein, 9 aa, BORRELIA OppA
YEFNTTRPP

SEQ ID NO: 2498 - protein, 9 aa, BORRELIA OppA
SESHQRIAI

SEQ ID NO: 2499 - protein, 9 aa, BORRELIA OppA
QEWKTMLDT

SEQ ID NO: 2500 - protein, 9 aa, BORRELIA OppA
SENTSQYSN

SEQ ID NO: 2501 - protein, 9 aa, BORRELIA OppA
YDQALVNAA

SEQ ID NO: 2502 - protein, 9 aa, BORRELIA OppA
AEDLLGRDV

SEQ ID NO: 2503 - protein, 10 aa, BORRELIA OppA
KEGVSFKISL

SEQ ID NO: 2504 - protein, 10 aa, BORRELIA OppA
AEPSSLDPQL

SEQ ID NO: 2505 - protein, 10 aa, BORRELIA OppA
REKIIWSDGV

SEQ ID NO: 2506 - protein, 10 aa, BORRELIA OppA
KETGSNYSEM

SEQ ID NO: 2507 - protein, 10 aa, BORRELIA OppA
AEKYGQSWTN

SEQ ID NO: 2508 - protein, 10 aa, BORRELIA OppA
VEVQEITFYT

SEQ ID NO: 2509 - protein, 10 aa, BORRELIA OppA
MYENGELDAI

SEQ ID NO: 2510 - protein, 10 aa, BORRELIA OppA
YENGELDAIF

SEQ ID NO: 2511 - protein, 10 aa, BORRELIA OppA
NGELDAIFSA

SEQ ID NO: 2512 - protein, 10 aa, BORRELIA OppA
GELDAIFSAI

SEQ ID NO: 2513 - protein, 10 aa, BORRELIA OppA
DRETLTYKVL

SEQ ID NO: 2514 - protein, 10 aa, BORRELIA OppA
RETLTYKVLD

SEQ ID NO: 2515 - protein, 10 aa, BORRELIA OppA
SEAHKKICEF

SEQ ID NO: 2516 - protein, 10 aa, BORRELIA OppA
LENEEWTTYL

SEQ ID NO: 2517 - protein, 10 aa, BORRELIA OppA
KEGISFKISL

SEQ ID NO: 2518 - protein, 10 aa, BORRELIA OppA
SEPSSLDPQL

SEQ ID NO: 2519 - protein, 10 aa, BORRELIA OppA
KETGSNYAEM

SEQ ID NO: 2520 - protein, 10 aa, BORRELIA OppA
AEKYGQSWTS

SEQ ID NO: 2521 - protein, 10 aa, BORRELIA OppA
MYENKELDAI

SEQ ID NO: 2522 - protein, 10 aa, BORRELIA OppA
YENKELDAIF

SEQ ID NO: 2523 - protein, 10 aa, BORRELIA OppA
KELDAIFGSI

SEQ ID NO: 2524 - protein, 10 aa, BORRELIA OppA
KEKAKEGVSF

SEQ ID NO: 2525 - protein, 10 aa, BORRELIA OppA
KETGSKYVEM

SEQ ID NO: 2526 - protein, 10 aa, BORRELIA OppA
TEKYGQSWTS

SEQ ID NO: 2527 - protein, 10 aa, BORRELIA OppA
KELDAIFVSI

SEQ ID NO: 2528 - protein, 10 aa, BORRELIA OppA
VEVQEIAFYT

SEQ ID NO: 2529 - protein, 10 aa, BORRELIA OppA
MYENEELDAI

SEQ ID NO: 2530 - protein, 10 aa, BORRELIA OppA
YENEELDAIF

SEQ ID NO: 2531 - protein, 10 aa, BORRELIA OppA
EELDAIFGSI

SEQ ID NO: 2532 - protein, 10 aa, BORRELIA OppA
DRETLAYKVL

SEQ ID NO: 2533 - protein, 10 aa, BORRELIA OppA
RETLAYKVLD

SEQ ID NO: 2534 - protein, 10 aa, BORRELIA OppA
RSLFLIIFFL

SEQ ID NO: 2535 - protein, 10 aa, BORRELIA OppA
VELEEITFYT

SEQ ID NO: 2536 - protein, 10 aa, BORRELIA OppA
KVESDVEFNI

SEQ ID NO: 2537 - protein, 10 aa, BORRELIA OppA
VESDVEFNIL

SEQ ID NO: 2538 - protein, 10 aa, BORRELIA OppA
DVEFNILSDL

SEQ ID NO: 2539 - protein, 10 aa, BORRELIA OppA
VEFNILSDLF

SEQ ID NO: 2540 - protein, 10 aa, BORRELIA OppA
FEGLVNVSPT

SEQ ID NO: 2541 - protein, 10 aa, BORRELIA OppA
AGEIDIVYTV

SEQ ID NO: 2542 - protein, 10 aa, BORRELIA OppA
GEIDIVYTVP

SEQ ID NO: 2543 - protein, 10 aa, BORRELIA OppA
YEFNTTRPPF

SEQ ID NO: 2544 - protein, 10 aa, BORRELIA OppA
AEAKKLLEEA

SEQ ID NO: 2545 - protein, 10 aa, BORRELIA OppA
TSESHQRIAI

SEQ ID NO: 2546 - protein, 10 aa, BORRELIA OppA
SESHQRIAIA

SEQ ID NO: 2547 - protein, 10 aa, BORRELIA OppA
QEWKTMLDTM

SEQ ID NO: 2548 - protein, 10 aa, BORRELIA OppA
QERGQFYQQA

SEQ ID NO: 2549 - protein, 11 aa, BORRELIA OppA
KETGSNYSEMV

SEQ ID NO: 2550 - protein, 11 aa, BORRELIA OppA
NGELDAIFSAI

SEQ ID NO: 2551 - protein, 11 aa, BORRELIA OppA
GELDAIFSAIP

SEQ ID NO: 2552 - protein, 11 aa, BORRELIA OppA
KETGSNYAEMV

SEQ ID NO: 2553 - protein, 11 aa, BORRELIA OppA
NKELDAIFGSI

SEQ ID NO: 2554 - protein, 11 aa, BORRELIA OppA
KELDAIFGSIP

SEQ ID NO: 2555 - protein, 11 aa, BORRELIA OppA
NKELDAIFVSI

SEQ ID NO: 2556 - protein, 11 aa, BORRELIA OppA
KELDAIFVSIP

SEQ ID NO: 2557 - protein, 11 aa, BORRELIA OppA
SDVEFNILSDL

SEQ ID NO: 2558 - protein, 11 aa, BORRELIA OppA
KAGEIDIVYTV

SEQ ID NO: 2559 - protein, 11 aa, BORRELIA OppA
AGEIDIVYTVP

SEQ ID NO: 2560 - protein, 11 aa, BORRELIA OppA
GEIDIVYTVPI

SEQ ID NO: 2561 - protein, 11 aa, BORRELIA OppA
YYEFNTTRPPF

SEQ ID NO: 2562 - protein, 11 aa, BORRELIA OppA
YEFNTTRPPFN

SEQ ID NO: 2563 - protein, 11 aa, BORRELIA OppA
NQEWKTMLDTM

SEQ ID NO: 2564 - protein, 11 aa, BORRELIA OppA
QEWKTMLDTMH

SEQ ID NO: 2565 - protein, 12 aa, BORRELIA OppA
REKIIWSDGVAI

SEQ ID NO: 2566 - protein, 12 aa, BORRELIA OppA
NKETGSNYSEMV

SEQ ID NO: 2567 - protein, 12 aa, BORRELIA OppA
YENGELDAIFSA

SEQ ID NO: 2568 - protein, 12 aa, BORRELIA OppA
ENGELDAIFSAI

SEQ ID NO: 2569 - protein, 12 aa, BORRELIA OppA
NGELDAIFSAIP

SEQ ID NO: 2570 - protein, 12 aa, BORRELIA OppA
GELDAIFSAIPP

SEQ ID NO: 2571 - protein, 12 aa, BORRELIA OppA
AEEIIIEKDFPI

SEQ ID NO: 2572 - protein, 12 aa, BORRELIA OppA
ENKELDAIFGSI

SEQ ID NO: 2573 - protein, 12 aa, BORRELIA OppA
NKELDAIFGSIP

SEQ ID NO: 2574 - protein, 12 aa, BORRELIA OppA
KELDAIFGSIPP

SEQ ID NO: 2575 - protein, 12 aa, BORRELIA OppA
ENKELDAIFVSI

SEQ ID NO: 2576 - protein, 12 aa, BORRELIA OppA
NKELDAIFVSIP

SEQ ID NO: 2577 - protein, 12 aa, BORRELIA OppA
KELDAIFVSIPP

SEQ ID NO: 2578 - protein, 12 aa, BORRELIA OppA
REKITWSDGVPI

SEQ ID NO: 2579 - protein, 12 aa, BORRELIA OppA
ESDVEFNILSDL

SEQ ID NO: 2580 - protein, 12 aa, BORRELIA OppA
SDVEFNILSDLF

SEQ ID NO: 2581 - protein, 12 aa, BORRELIA OppA
YKAGEIDIVYTV

SEQ ID NO: 2582 - protein, 12 aa, BORRELIA OppA
KAGEIDIVYTVP

SEQ ID NO: 2583 - protein, 12 aa, BORRELIA OppA
AGEIDIVYTVPI

SEQ ID NO: 2584 - protein, 12 aa, BORRELIA OppA
GEIDIVYTVPIN

SEQ ID NO: 2585 - protein, 12 aa, BORRELIA OppA
YYYEFNTTRPPF

SEQ ID NO: 2586 - protein, 12 aa, BORRELIA OppA
YEFNTTRPPFND

SEQ ID NO: 2587 - protein, 12 aa, BORRELIA OppA
LEEAGFNASHPL

SEQ ID NO: 2588 - protein, 12 aa, BORRELIA OppA
QNQEWKTMLDTM

SEQ ID NO: 2589 - protein, 12 aa, BORRELIA OppA
NQEWKTMLDTMH

SEQ ID NO: 2590 - protein, 12 aa, BORRELIA OppA
QEWKTMLDTMHT

SEQ ID NO: 2591 - protein, 9 aa, BORRELIA OppA
EEKKEGVSF

SEQ ID NO: 2592 - protein, 9 aa, BORRELIA OppA
AEGIRKSYL

SEQ ID NO: 2593 - protein, 9 aa, BORRELIA OppA
IDMLVHQSF

SEQ ID NO: 2594 - protein, 9 aa, BORRELIA OppA
KERIPNEKY

SEQ ID NO: 2595 - protein, 9 aa, BORRELIA OppA
VEVQEITFY

SEQ ID NO: 2596 - protein, 9 aa, BORRELIA OppA
LENEEWTTY

SEQ ID NO: 2597 - protein, 9 aa, BORRELIA OppA
YEIARAGWI

SEQ ID NO: 2598 - protein, 9 aa, BORRELIA OppA
EEIIIEKDF

SEQ ID NO: 2599 - protein, 9 aa, BORRELIA OppA
EEKKEGISF

SEQ ID NO: 2600 - protein, 9 aa, BORRELIA OppA
AEDNVASKM

SEQ ID NO: 2601 - protein, 9 aa, BORRELIA OppA
VEVQEIAFY

SEQ ID NO: 2602 - protein, 9 aa, BORRELIA OppA
KERKEGVSF

SEQ ID NO: 2603 - protein, 9 aa, BORRELIA OppA
VELEEITFY

SEQ ID NO: 2604 - protein, 9 aa, BORRELIA OppA
WENKDNTVW

SEQ ID NO: 2605 - protein, 9 aa, BORRELIA OppA
TAQDVVWSW

SEQ ID NO: 2606 - protein, 9 aa, BORRELIA OppA
SEAADVNRY

SEQ ID NO: 2607 - protein, 9 aa, BORRELIA OppA
GEIDIVYTV

SEQ ID NO: 2608 - protein, 9 aa, BORRELIA OppA
SESHQRIAI

SEQ ID NO: 2609 - protein, 9 aa, BORRELIA OppA
ADYDDAATF

SEQ ID NO: 2610 - protein, 9 aa, BORRELIA OppA
SENTSQYSN

SEQ ID NO: 2611 - protein, 9 aa, BORRELIA OppA
AEDLLGRDV

SEQ ID NO: 2612 - protein, 10 aa, BORRELIA OppA
KEEKKEGVSF

SEQ ID NO: 2613 - protein, 10 aa, BORRELIA OppA
AEPSSLDPQL

SEQ ID NO: 2614 - protein, 10 aa, BORRELIA OppA
KETGSNYSEM

SEQ ID NO: 2615 - protein, 10 aa, BORRELIA OppA
FIDMLVHQSF

SEQ ID NO: 2616 - protein, 10 aa, BORRELIA OppA
QVEVQEITFY

SEQ ID NO: 2617 - protein, 10 aa, BORRELIA OppA
YENGELDAIF

SEQ ID NO: 2618 - protein, 10 aa, BORRELIA OppA
GELDAIFSAI

SEQ ID NO: 2619 - protein, 10 aa, BORRELIA OppA
SEAHKKICEF

SEQ ID NO: 2620 - protein, 10 aa, BORRELIA OppA
ELENEEWTTY

SEQ ID NO: 2621 - protein, 10 aa, BORRELIA OppA
NYEIARAGWI

SEQ ID NO: 2622 - protein, 10 aa, BORRELIA OppA
AEEIIIEKDF

SEQ ID NO: 2623 - protein, 10 aa, BORRELIA OppA
KEEKKEGISF

SEQ ID NO: 2624 - protein, 10 aa, BORRELIA OppA
KEGISFKISL

SEQ ID NO: 2625 - protein, 10 aa, BORRELIA OppA
KETGSNYAEM

SEQ ID NO: 2626 - protein, 10 aa, BORRELIA OppA
AEMVKSTIKN

SEQ ID NO: 2627 - protein, 10 aa, BORRELIA OppA
MYENKELDAI

SEQ ID NO: 2628 - protein, 10 aa, BORRELIA OppA
YENKELDAIF

SEQ ID NO: 2629 - protein, 10 aa, BORRELIA OppA
KEKAKEGVSF

SEQ ID NO: 2630 - protein, 10 aa, BORRELIA OppA
AEDNVASKMI

SEQ ID NO: 2631 - protein, 10 aa, BORRELIA OppA
NEVEVQEITF

SEQ ID NO: 2632 - protein, 10 aa, BORRELIA OppA
EVEVQEITFY

SEQ ID NO: 2633 - protein, 10 aa, BORRELIA OppA
KELDAIFVSI

SEQ ID NO: 2634 - protein, 10 aa, BORRELIA OppA
SEVEVQEIAF

SEQ ID NO: 2635 - protein, 10 aa, BORRELIA OppA
EVEVQEIAFY

SEQ ID NO: 2636 - protein, 10 aa, BORRELIA OppA
MYENEELDAI

SEQ ID NO: 2637 - protein, 10 aa, BORRELIA OppA
YENEELDAIF

SEQ ID NO: 2638 - protein, 10 aa, BORRELIA OppA
NKERKEGVSF

SEQ ID NO: 2639 - protein, 10 aa, BORRELIA OppA
NEVELEEITF

SEQ ID NO: 2640 - protein, 10 aa, BORRELIA OppA
EVELEEITFY

SEQ ID NO: 2641 - protein, 10 aa, BORRELIA OppA
NEANKKICEF

SEQ ID NO: 2642 - protein, 10 aa, BORRELIA OppA
VEFNILSDLF

SEQ ID NO: 2643 - protein, 10 aa, BORRELIA OppA
KWENKDNTVW

SEQ ID NO: 2644 - protein, 10 aa, BORRELIA OppA
TSEAADVNRY

SEQ ID NO: 2645 - protein, 10 aa, BORRELIA OppA
SEAADVNRYK

SEQ ID NO: 2646 - protein, 10 aa, BORRELIA OppA
AGEIDIVYTV

SEQ ID NO: 2647 - protein, 10 aa, BORRELIA OppA
YEFNTTRPPF

SEQ ID NO: 2648 - protein, 10 aa, BORRELIA OppA
VEAKLQNQEW

SEQ ID NO: 2649 - protein, 10 aa, BORRELIA OppA
QEWKTMLDTM

SEQ ID NO: 2650 - protein, 11 aa, BORRELIA OppA
AEAGYPNGNGF

SEQ ID NO: 2651 - protein, 11 aa, BORRELIA OppA
SEVEVQEIAFY

SEQ ID NO: 2652 - protein, 11 aa, BORRELIA OppA
GEIQPRLAEKW

SEQ ID NO: 2653 - protein, 11 aa, BORRELIA OppA
WENKDNTVWTF

SEQ ID NO: 2654 - protein, 11 aa, BORRELIA OppA
GVEAKLQNQEW

SEQ ID NO: 2655 - protein, 11 aa, BORRELIA OppA
VEAKLQNQEWK

SEQ ID NO: 2656 - protein, 12 aa, BORRELIA OppA
TGEIQPRLAEKW

SEQ ID NO: 2657 - protein, 12 aa, BORRELIA OppA
GEIQPRLAEKWE

SEQ ID NO: 2658 - protein, 12 aa, BORRELIA OppA
AEKWENKDNTVW

SEQ ID NO: 2659 - protein, 12 aa, BORRELIA OppA
AEAKKLLEEAGF

SEQ ID NO: 2660 - protein, 12 aa, BORRELIA OppA
VEAKLQNQEWKT

SEQ ID NO: 2661 - protein, 12 aa, BORRELIA OppA
SENTSQYSNPDY

SEQ ID NO: 2662 - protein, 9 aa, BORRELIA OppA
AEKYGQSWT

SEQ ID NO: 2663 - protein, 9 aa, BORRELIA OppA
QEITFYTTN

SEQ ID NO: 2664 - protein, 9 aa, BORRELIA OppA
GELDAIFSA

SEQ ID NO: 2665 - protein, 9 aa, BORRELIA OppA
EEWTTYLNT

SEQ ID NO: 2666 - protein, 9 aa, BORRELIA OppA
AEMVKSTIK

SEQ ID NO: 2667 - protein, 9 aa, BORRELIA OppA
TEKYGQSWT

SEQ ID NO: 2668 - protein, 9 aa, BORRELIA OppA
KELDAIFVS

SEQ ID NO: 2669 - protein, 9 aa, BORRELIA OppA
SEVEVQEIA

SEQ ID NO: 2670 - protein, 9 aa, BORRELIA OppA
QEIAFYTTN

SEQ ID NO: 2671 - protein, 9 aa, BORRELIA OppA
TEKYGQNWT

SEQ ID NO: 2672 - protein, 9 aa, BORRELIA OppA
LEEITFYTT

SEQ ID NO: 2673 - protein, 9 aa, BORRELIA OppA
EEITFYTTN

SEQ ID NO: 2674 - protein, 9 aa, BORRELIA OppA
GEIDIVYTV

SEQ ID NO: 2675 - protein, 9 aa, BORRELIA OppA
LEEAGFNAS

SEQ ID NO: 2676 - protein, 9 aa, BORRELIA OppA
EEAGFNASH

SEQ ID NO: 2677 - protein, 9 aa, BORRELIA OppA
SESHQRIAI

SEQ ID NO: 2678 - protein, 9 aa, BORRELIA OppA
QEWKTMLDT

SEQ ID NO: 2679 - protein, 9 aa, BORRELIA OppA
AEDLLGRDV

SEQ ID NO: 2680 - protein, 10 aa, BORRELIA OppA
NGELDAIFSA

SEQ ID NO: 2681 - protein, 10 aa, BORRELIA OppA
GELDAIFSAI

SEQ ID NO: 2682 - protein, 10 aa, BORRELIA OppA
NPEIAKTLLA

SEQ ID NO: 2683 - protein, 10 aa, BORRELIA OppA
NEEWTTYLNT

SEQ ID NO: 2684 - protein, 10 aa, BORRELIA OppA
AEKYGQSWTS

SEQ ID NO: 2685 - protein, 10 aa, BORRELIA OppA
KELDAIFVSI

SEQ ID NO: 2686 - protein, 10 aa, BORRELIA OppA
SSEVEVQEIA

SEQ ID NO: 2687 - protein, 10 aa, BORRELIA OppA
QEIAFYTTND

SEQ ID NO: 2688 - protein, 10 aa, BORRELIA OppA
EELDAIFGSI

SEQ ID NO: 2689 - protein, 10 aa, BORRELIA OppA
ELEEITFYTT

SEQ ID NO: 2690 - protein, 10 aa, BORRELIA OppA
SLELFNPEIA

SEQ ID NO: 2691 - protein, 10 aa, BORRELIA OppA
LEVTLTQPNA

SEQ ID NO: 2692 - protein, 10 aa, BORRELIA OppA
KPEHLVTSGA

SEQ ID NO: 2693 - protein, 10 aa, BORRELIA OppA
AGEIDIVYTV

SEQ ID NO: 2694 - protein, 10 aa, BORRELIA OppA
AEAKKLLEEA

SEQ ID NO: 2695 - protein, 10 aa, BORRELIA OppA
SESHQRIAIA

SEQ ID NO: 2696 - protein, 10 aa, BORRELIA OppA
QERGQFYQQA

SEQ ID NO: 2697 - protein, 11 aa, BORRELIA OppA
REKIIWSDGVA

SEQ ID NO: 2698 - protein, 11 aa, BORRELIA OppA
REKITWSDGVA

SEQ ID NO: 2699 - protein, 11 aa, BORRELIA OppA
EEWTTYLNTKA

SEQ ID NO: 2700 - protein, 11 aa, BORRELIA OppA
AERNPRYWDNA

SEQ ID NO: 2701 - protein, 11 aa, BORRELIA OppA
SEAADVNRYKA

SEQ ID NO: 2702 - protein, 11 aa, BORRELIA OppA
IAEAKKLLEEA

SEQ ID NO: 2703 - protein, 11 aa, BORRELIA OppA
AEAKKLLEEAG

SEQ ID NO: 2704 - protein, 11 aa, BORRELIA OppA
TSESHQRIAIA

SEQ ID NO: 2705 - protein, 11 aa, BORRELIA OppA
SESHQRIAIAA

SEQ ID NO: 2706 - protein, 11 aa, BORRELIA OppA
TQERGQFYQQA

SEQ ID NO: 2707 - protein, 11 aa, BORRELIA OppA
QERGQFYQQAE

SEQ ID NO: 2708 - protein, 11 aa, BORRELIA OppA
AEDLLGRDVPA

SEQ ID NO: 2709 - protein, 12 aa, BORRELIA OppA
LREKIIWSDGVA

SEQ ID NO: 2710 - protein, 12 aa, BORRELIA OppA
EEIIIEKDFPIA

SEQ ID NO: 2711 - protein, 12 aa, BORRELIA OppA
LREKITWSDGVA

SEQ ID NO: 2712 - protein, 12 aa, BORRELIA OppA
QEIAFYTTNDSS

SEQ ID NO: 2713 - protein, 12 aa, BORRELIA OppA
NEEWTTYLNTKA

SEQ ID NO: 2714 - protein, 12 aa, BORRELIA OppA
EEWTTYLNTKAN

SEQ ID NO: 2715 - protein, 12 aa, BORRELIA OppA
VAERNPRYWDNA

SEQ ID NO: 2716 - protein, 12 aa, BORRELIA OppA
AERNPRYWDNAH

SEQ ID NO: 2717 - protein, 12 aa, BORRELIA OppA
TSEAADVNRYKA

SEQ ID NO: 2718 - protein, 12 aa, BORRELIA OppA
SEAADVNRYKAG

SEQ ID NO: 2719 - protein, 12 aa, BORRELIA OppA
RIAEAKKLLEEA

SEQ ID NO: 2720 - protein, 12 aa, BORRELIA OppA
IAEAKKLLEEAG

SEQ ID NO: 2721 - protein, 12 aa, BORRELIA OppA
AEAKKLLEEAGF

SEQ ID NO: 2722 - protein, 12 aa, BORRELIA OppA
TSESHQRIAIAA

SEQ ID NO: 2723 - protein, 12 aa, BORRELIA OppA
SESHQRIAIAAS

SEQ ID NO: 2724 - protein, 12 aa, BORRELIA OppA
TTQERGQFYQQA

SEQ ID NO: 2725 - protein, 12 aa, BORRELIA OppA
TQERGQFYQQAE

SEQ ID NO: 2726 - protein, 12 aa, BORRELIA OppA
QERGQFYQQAED

SEQ ID NO: 2727 - protein, 12 aa, BORRELIA OppA
QAEDLLGRDVPA

SEQ ID NO: 2728 - protein, 12 aa, BORRELIA OppA
AEDLLGRDVPAI

SEQ ID NO: 2729 - protein, 9 aa, BORRELIA OppA
LAHPSMVPV

SEQ ID NO: 2730 - protein, 9 aa, BORRELIA OppA
VPINQFAQL

SEQ ID NO: 2731 - protein, 10 aa, BORRELIA OppA
VPAIPVYHYV

SEQ ID NO: 2732 - protein, 9 aa, Borrelia DbpA
FTDKQTGSK

SEQ ID NO: 2733 - protein, 9 aa, Borrelia DbpA
SSGAFSAMY

SEQ ID NO: 2734 - protein, 9 aa, Borrelia DbpA
FSGIYDLIY

SEQ ID NO: 2735 - protein, 9 aa, Borrelia DbpA
FTDKQTGSK

SEQ ID NO: 2736 - protein, 9 aa, Borrelia DbpA
SSGAFSAMY

SEQ ID NO: 2737 - protein, 9 aa, Borrelia DbpA
SSGEFSAMY

SEQ ID NO: 2738 - protein, 9 aa, Borrelia DbpA
FSAMYDLMF

SEQ ID NO: 2739 - protein, 9 aa, Borrelia DbpA
FTDQKTGAK

SEQ ID NO: 2740 - protein, 9 aa, Borrelia DbpA
FTDSATGGK

SEQ ID NO: 2741 - protein, 9 aa, Borrelia DbpA
SSGEFSAMY

SEQ ID NO: 2742 - protein, 9 aa, Borrelia DbpA
FSAMYDLMF

SEQ ID NO: 2743 - protein, 10 aa, Borrelia DbpA
FTDKQTGSKV

SEQ ID NO: 2744 - protein, 10 aa, Borrelia DbpA
GSSGAFSAMY

SEQ ID NO: 2745 - protein, 10 aa, Borrelia DbpA
EFSGIYDLIY

SEQ ID NO: 2746 - protein, 10 aa, Borrelia DbpA
FSGIYDLIYR

SEQ ID NO: 2747 - protein, 10 aa, Borrelia DbpA
FTDKQTGSKV

SEQ ID NO: 2748 - protein, 10 aa, Borrelia DbpA
GSSGAFSAMY

SEQ ID NO: 2749 - protein, 9 aa, Borrelia DbpA
GSSGEFSAM

SEQ ID NO: 2750 - protein, 10 aa, Borrelia DbpA
FTDSATGGKV

SEQ ID NO: 2751 - protein, 10 aa, Borrelia DbpA
GSSGEFSAMY

SEQ ID NO: 2752 - protein, 11 aa, Borrelia DbpA
DEFSGIYDLIY

SEQ ID NO: 2753 - protein, 12 aa, Borrelia DbpA
EDEFSGIYDLIY

SEQ ID NO: 2754 - protein, 12 aa, Borrelia DbpA
ETGSSGEFSAMY

SEQ ID NO: 2755 - protein, 9 aa, Borrelia DbpA
KIILTLTLL

SEQ ID NO: 2756 - protein, 9 aa, Borrelia DbpA
IILTLTLLA

SEQ ID NO: 2757 - protein, 9 aa, Borrelia DbpA
LTLTLLASL

SEQ ID NO: 2758 - protein, 9 aa, Borrelia DbpA
TLLASLLAA

SEQ ID NO: 2759 - protein, 9 aa, Borrelia DbpA
LLASLLAAC

SEQ ID NO: 2760 - protein, 9 aa, Borrelia DbpA
SLLAACSLT

SEQ ID NO: 2761 - protein, 9 aa, Borrelia DbpA
GIYDLILNA

SEQ ID NO: 2762 - protein, 9 aa, Borrelia DbpA
GMKDMTKTV

SEQ ID NO: 2763 - protein, 9 aa, Borrelia DbpA
TTANGIIEI

SEQ ID NO: 2764 - protein, 9 aa, Borrelia DbpA
GMQGMKQAV

SEQ ID NO: 2765 - protein, 9 aa, Borrelia DbpA
TTADGIIAI

SEQ ID NO: 2766 - protein, 9 aa, Borrelia DbpA
NLIKLSLIV

SEQ ID NO: 2767 - protein, 9 aa, Borrelia DbpA
KLSLIVSLL

SEQ ID NO: 2768 - protein, 9 aa, Borrelia DbpA
SLIVSLLVA

SEQ ID NO: 2769 - protein, 9 aa, Borrelia DbpA
KLESSAQEI

SEQ ID NO: 2770 - protein, 9 aa, Borrelia DbpA
FILKAKIQA

SEQ ID NO: 2771 - protein, 9 aa, Borrelia DbpA
FSAMYDLML

SEQ ID NO: 2772 - protein, 9 aa, Borrelia DbpA
AMYDLMLDV

SEQ ID NO: 2773 - protein, 9 aa, Borrelia DbpA
LMLDVSKPL

SEQ ID NO: 2774 - protein, 9 aa, Borrelia DbpA
KMTGTVTQA

SEQ ID NO: 2775 - protein, 9 aa, Borrelia DbpA
TTAEGILAI

SEQ ID NO: 2776 - protein, 9 aa, Borrelia DbpA
AMEDKLNNV

SEQ ID NO: 2777 - protein, 9 aa, Borrelia DbpA
NLLKLTLIV

SEQ ID NO: 2778 - protein, 9 aa, Borrelia DbpA
KLTLIVGLL

SEQ ID NO: 2779 - protein, 9 aa, Borrelia DbpA
TLIVGLLVA

SEQ ID NO: 2780 - protein, 9 aa, Borrelia DbpA
FLKEIEEEA

SEQ ID NO: 2781 - protein, 9 aa, Borrelia DbpA
QLLKDMYDL

SEQ ID NO: 2782 - protein, 9 aa, Borrelia DbpA
DMYDLMLNA

SEQ ID NO: 2783 - protein, 9 aa, Borrelia DbpA
LMLNAAGSL

SEQ ID NO: 2784 - protein, 9 aa, Borrelia DbpA
GLQEMIKTV

SEQ ID NO: 2785 - protein, 9 aa, Borrelia DbpA
TTVEGILMI

SEQ ID NO: 2786 - protein, 9 aa, Borrelia DbpA
NLLKLSLIV

SEQ ID NO: 2787 - protein, 9 aa, Borrelia DbpA
KVSEKPEFI

SEQ ID NO: 2788 - protein, 9 aa, Borrelia DbpA
KMTGTVTQV

SEQ ID NO: 2789 - protein, 9 aa, Borrelia DbpA
AMEDKLKNV

SEQ ID NO: 2790 - protein, 9 aa, Borrelia DbpA
KIILTLTLL

SEQ ID NO: 2791 - protein, 9 aa, Borrelia DbpA
IILTLTLLA

SEQ ID NO: 2792 - protein, 9 aa, Borrelia DbpA
LTLTLLASL

SEQ ID NO: 2793 - protein, 9 aa, Borrelia DbpA
TLLASLLAA

SEQ ID NO: 2794 - protein, 9 aa, Borrelia DbpA
LLASLLAAC

SEQ ID NO: 2795 - protein, 9 aa, Borrelia DbpA
SLLAACSLT

SEQ ID NO: 2796 - protein, 9 aa, Borrelia DbpA
GIYDLIYRT

SEQ ID NO: 2797 - protein, 9 aa, Borrelia DbpA
LIYRTAEAV

SEQ ID NO: 2798 - protein, 9 aa, Borrelia DbpA
TTANGIIAI

SEQ ID NO: 2799 - protein, 9 aa, Borrelia DbpA
NLLKLSLIV

SEQ ID NO: 2800 - protein, 9 aa, Borrelia DbpA
KLSLIVSLL

SEQ ID NO: 2801 - protein, 9 aa, Borrelia DbpA
SLIVSLLVA

SEQ ID NO: 2802 - protein, 9 aa, Borrelia DbpA
KVSEKPEFI

SEQ ID NO: 2803 - protein, 9 aa, Borrelia DbpA
FSAMYDLML

SEQ ID NO: 2804 - protein, 9 aa, Borrelia DbpA
AMYDLMLDV

SEQ ID NO: 2805 - protein, 9 aa, Borrelia DbpA
LMLDVSKPL

SEQ ID NO: 2806 - protein, 9 aa, Borrelia DbpA
TTAEGILAI

SEQ ID NO: 2807 - protein, 9 aa, Borrelia DbpA
AMEEKLNNV

SEQ ID NO: 2808 - protein, 9 aa, Borrelia DbpA
KTFNNLLKL

SEQ ID NO: 2809 - protein, 9 aa, Borrelia DbpA
NLLKLTILV

SEQ ID NO: 2810 - protein, 9 aa, Borrelia DbpA
KLTILVNLL

SEQ ID NO: 2811 - protein, 9 aa, Borrelia DbpA
ILVNLLISC

SEQ ID NO: 2812 - protein, 9 aa, Borrelia DbpA
LISCGLTGA

SEQ ID NO: 2813 - protein, 9 aa, Borrelia DbpA
GVSENPFIL

SEQ ID NO: 2814 - protein, 9 aa, Borrelia DbpA
FILEAKVRA

SEQ ID NO: 2815 - protein, 9 aa, Borrelia DbpA
FVIAIEEEA

SEQ ID NO: 2816 - protein, 9 aa, Borrelia DbpA
AMYDLMFEV

SEQ ID NO: 2817 - protein, 9 aa, Borrelia DbpA
LMFEVSKPL

SEQ ID NO: 2818 - protein, 9 aa, Borrelia DbpA
KMREKLQRV

SEQ ID NO: 2819 - protein, 9 aa, Borrelia DbpA
IIALTLQFL

SEQ ID NO: 2820 - protein, 9 aa, Borrelia DbpA
FLKETKEEA

SEQ ID NO: 2821 - protein, 9 aa, Borrelia DbpA
ELYELMLKI

SEQ ID NO: 2822 - protein, 9 aa, Borrelia DbpA
LMLKISKAV

SEQ ID NO: 2823 - protein, 9 aa, Borrelia DbpA
GIQNMTATV

SEQ ID NO: 2824 - protein, 9 aa, Borrelia DbpA
MTATVSMGI

SEQ ID NO: 2825 - protein, 9 aa, Borrelia DbpA
KTFNNLLKL

SEQ ID NO: 2826 - protein, 9 aa, Borrelia DbpA
NLLKLTILV

SEQ ID NO: 2827 - protein, 9 aa, Borrelia DbpA
KLTILVNLL

SEQ ID NO: 2828 - protein, 9 aa, Borrelia DbpA
ILVNLLISC

SEQ ID NO: 2829 - protein, 9 aa, Borrelia DbpA
LISCGLTGA

SEQ ID NO: 2830 - protein, 9 aa, Borrelia DbpA
AIVDEIDAI

SEQ ID NO: 2831 - protein, 9 aa, Borrelia DbpA
FLTAIEEEA

SEQ ID NO: 2832 - protein, 9 aa, Borrelia DbpA
AMYDLMFEV

SEQ ID NO: 2833 - protein, 9 aa, Borrelia DbpA
LMFEVSKPL

SEQ ID NO: 2834 - protein, 9 aa, Borrelia DbpA
GIQDMTKEV

SEQ ID NO: 2835 - protein, 9 aa, Borrelia DbpA
KMREKLIRV

SEQ ID NO: 2836 - protein, 10 aa, Borrelia DbpA
KIILTLTLLA

SEQ ID NO: 2837 - protein, 10 aa, Borrelia DbpA
ILTLTLLASL

SEQ ID NO: 2838 - protein, 10 aa, Borrelia DbpA
LTLLASLLAA

SEQ ID NO: 2839 - protein, 10 aa, Borrelia DbpA
TLLASLLAAC

SEQ ID NO: 2840 - protein, 10 aa, Borrelia DbpA
RVADLTIKFL

SEQ ID NO: 2841 - protein, 10 aa, Borrelia DbpA
FLEATEEETI

SEQ ID NO: 2842 - protein, 10 aa, Borrelia DbpA
SGIYDLILNA

SEQ ID NO: 2843 - protein, 10 aa, Borrelia DbpA
GIYDLILNAA

SEQ ID NO: 2844 - protein, 10 aa, Borrelia DbpA
TTADGIIAIV

SEQ ID NO: 2845 - protein, 10 aa, Borrelia DbpA
KNLIKLSLIV

SEQ ID NO: 2846 - protein, 10 aa, Borrelia DbpA
LIKLSLIVSL

SEQ ID NO: 2847 - protein, 10 aa, Borrelia DbpA
IKLSLIVSLL

SEQ ID NO: 2848 - protein, 10 aa, Borrelia DbpA
KLSLIVSLLV

SEQ ID NO: 2849 - protein, 10 aa, Borrelia DbpA
FILKAKIQAI

SEQ ID NO: 2850 - protein, 10 aa, Borrelia DbpA
SAMYDLMLDV

SEQ ID NO: 2851 - protein, 10 aa, Borrelia DbpA
AMYDLMLDVS

SEQ ID NO: 2852 - protein, 10 aa, Borrelia DbpA
DLMLDVSKPL

SEQ ID NO: 2853 - protein, 10 aa, Borrelia DbpA
LMLDVSKPLE

SEQ ID NO: 2854 - protein, 10 aa, Borrelia DbpA
KAMEDKLNNV

SEQ ID NO: 2855 - protein, 10 aa, Borrelia DbpA
KNLLKLTLIV

SEQ ID NO: 2856 - protein, 10 aa, Borrelia DbpA
NLLKLTLIVG

SEQ ID NO: 2857 - protein, 10 aa, Borrelia DbpA
LLKLTLIVGL

SEQ ID NO: 2858 - protein, 10 aa, Borrelia DbpA
KLTLIVGLLV

SEQ ID NO: 2859 - protein, 10 aa, Borrelia DbpA
QLLKDMYDLM

SEQ ID NO: 2860 - protein, 10 aa, Borrelia DbpA
LLKDMYDLML

SEQ ID NO: 2861 - protein, 10 aa, Borrelia DbpA
KDMYDLMLNA

SEQ ID NO: 2862 - protein, 10 aa, Borrelia DbpA
LGLQEMIKTV

SEQ ID NO: 2863 - protein, 10 aa, Borrelia DbpA
KNLLKLSLIV

SEQ ID NO: 2864 - protein, 10 aa, Borrelia DbpA
LLKLSLIVSL

SEQ ID NO: 2865 - protein, 10 aa, Borrelia DbpA
LKLSLIVSLL

SEQ ID NO: 2866 - protein, 10 aa, Borrelia DbpA
QKMTGTVTQV

SEQ ID NO: 2867 - protein, 10 aa, Borrelia DbpA
KIILTLTLLA

SEQ ID NO: 2868 - protein, 10 aa, Borrelia DbpA
ILTLTLLASL

SEQ ID NO: 2869 - protein, 10 aa, Borrelia DbpA
LTLLASLLAA

SEQ ID NO: 2870 - protein, 10 aa, Borrelia DbpA
TLLASLLAAC

SEQ ID NO: 2871 - protein, 10 aa, Borrelia DbpA
LVADLTIEFL

SEQ ID NO: 2872 - protein, 10 aa, Borrelia DbpA
FLKATEEETI

SEQ ID NO: 2873 - protein, 10 aa, Borrelia DbpA
GIYDLIYRTA

SEQ ID NO: 2874 - protein, 10 aa, Borrelia DbpA
YDLIYRTAEA

SEQ ID NO: 2875 - protein, 10 aa, Borrelia DbpA
KNLLKLSLIV

SEQ ID NO: 2876 - protein, 10 aa, Borrelia DbpA
LLKLSLIVSL

SEQ ID NO: 2877 - protein, 10 aa, Borrelia DbpA
LKLSLIVSLL

SEQ ID NO: 2878 - protein, 10 aa, Borrelia DbpA
KLSLIVSLLV

SEQ ID NO: 2879 - protein, 10 aa, Borrelia DbpA
SAMYDLMLDV

SEQ ID NO: 2880 - protein, 10 aa, Borrelia DbpA
AMYDLMLDVS

SEQ ID NO: 2881 - protein, 10 aa, Borrelia DbpA
DLMLDVSKPL

SEQ ID NO: 2882 - protein, 10 aa, Borrelia DbpA
LMLDVSKPLE

SEQ ID NO: 2883 - protein, 10 aa, Borrelia DbpA
QAMEEKLNNV

SEQ ID NO: 2884 - protein, 10 aa, Borrelia DbpA
NNLLKLTILV

SEQ ID NO: 2885 - protein, 10 aa, Borrelia DbpA
NLLKLTILVN

SEQ ID NO: 2886 - protein, 10 aa, Borrelia DbpA
LLKLTILVNL

SEQ ID NO: 2887 - protein, 10 aa, Borrelia DbpA
KLTILVNLLI

SEQ ID NO: 2888 - protein, 10 aa, Borrelia DbpA
LLISCGLTGA

SEQ ID NO: 2889 - protein, 10 aa, Borrelia DbpA
TVAEKFVIAI

SEQ ID NO: 2890 - protein, 10 aa, Borrelia DbpA
SAMYDLMFEV

SEQ ID NO: 2891 - protein, 10 aa, Borrelia DbpA
AMYDLMFEVS

SEQ ID NO: 2892 - protein, 10 aa, Borrelia DbpA
DLMFEVSKPL

SEQ ID NO: 2893 - protein, 10 aa, Borrelia DbpA
LMFEVSKPLQ

SEQ ID NO: 2894 - protein, 10 aa, Borrelia DbpA
RIIALTLQFL

SEQ ID NO: 2895 - protein, 10 aa, Borrelia DbpA
KELYELMLKI

SEQ ID NO: 2896 - protein, 10 aa, Borrelia DbpA
YELMLKISKA

SEQ ID NO: 2897 - protein, 10 aa, Borrelia DbpA
ELMLKISKAV

SEQ ID NO: 2898 - protein, 10 aa, Borrelia DbpA
NMTATVSMGI

SEQ ID NO: 2899 - protein, 10 aa, Borrelia DbpA
MTATVSMGIV

SEQ ID NO: 2900 - protein, 10 aa, Borrelia DbpA
NNLLKLTILV

SEQ ID NO: 2901 - protein, 10 aa, Borrelia DbpA
NLLKLTILVN

SEQ ID NO: 2902 - protein, 10 aa, Borrelia DbpA
LLKLTILVNL

SEQ ID NO: 2903 - protein, 10 aa, Borrelia DbpA
KLTILVNLLI

SEQ ID NO: 2904 - protein, 10 aa, Borrelia DbpA
LLISCGLTGA

SEQ ID NO: 2905 - protein, 10 aa, Borrelia DbpA
KFLTAIEEEA

SEQ ID NO: 2906 - protein, 10 aa, Borrelia DbpA
SAMYDLMFEV

SEQ ID NO: 2907 - protein, 10 aa, Borrelia DbpA
AMYDLMFEVS

SEQ ID NO: 2908 - protein, 10 aa, Borrelia DbpA
DLMFEVSKPL

SEQ ID NO: 2909 - protein, 10 aa, Borrelia DbpA
LMFEVSKPLQ

SEQ ID NO: 2910 - protein, 10 aa, Borrelia DbpA
KKMREKLIRV

SEQ ID NO: 2911 - protein, 11 aa, Borrelia DbpA
IILTLTLLASL

SEQ ID NO: 2912 - protein, 11 aa, Borrelia DbpA
LLASLLAACSL

SEQ ID NO: 2913 - protein, 11 aa, Borrelia DbpA
FSGIYDLILNA

SEQ ID NO: 2914 - protein, 11 aa, Borrelia DbpA
NLIKLSLIVSL

SEQ ID NO: 2915 - protein, 11 aa, Borrelia DbpA
IKLSLIVSLLV

SEQ ID NO: 2916 - protein, 11 aa, Borrelia DbpA
FSAMYDLMLDV

SEQ ID NO: 2917 - protein, 11 aa, Borrelia DbpA
SAMYDLMLDVS

SEQ ID NO: 2918 - protein, 11 aa, Borrelia DbpA
YDLMLDVSKPL

SEQ ID NO: 2919 - protein, 11 aa, Borrelia DbpA
IKNLLKLTLIV

SEQ ID NO: 2920 - protein, 11 aa, Borrelia DbpA
NLLKLTLIVGL

SEQ ID NO: 2921 - protein, 11 aa, Borrelia DbpA
FLKEIEEEANI

SEQ ID NO: 2922 - protein, 11 aa, Borrelia DbpA
LKDMYDLMLNA

SEQ ID NO: 2923 - protein, 11 aa, Borrelia DbpA
LMIANTIEDKL

SEQ ID NO: 2924 - protein, 11 aa, Borrelia DbpA
KKNLLKLSLIV

SEQ ID NO: 2925 - protein, 11 aa, Borrelia DbpA
NLLKLSLIVSL

SEQ ID NO: 2926 - protein, 11 aa, Borrelia DbpA
LKLSLIVSLLV

SEQ ID NO: 2927 - protein, 11 aa, Borrelia DbpA
IILTLTLLASL

SEQ ID NO: 2928 - protein, 11 aa, Borrelia DbpA
LLASLLAACSL

SEQ ID NO: 2929 - protein, 11 aa, Borrelia DbpA
KLVADLTIEFL

SEQ ID NO: 2930 - protein, 11 aa, Borrelia DbpA
KKNLLKLSLIV

SEQ ID NO: 2931 - protein, 11 aa, Borrelia DbpA
NLLKLSLIVSL

SEQ ID NO: 2932 - protein, 11 aa, Borrelia DbpA
LKLSLIVSLLV

SEQ ID NO: 2933 - protein, 11 aa, Borrelia DbpA
FSAMYDLMLDV

SEQ ID NO: 2934 - protein, 11 aa, Borrelia DbpA
SAMYDLMLDVS

SEQ ID NO: 2935 - protein, 11 aa, Borrelia DbpA
YDLMLDVSKPL

SEQ ID NO: 2936 - protein, 11 aa, Borrelia DbpA
FNNLLKLTILV

SEQ ID NO: 2937 - protein, 11 aa, Borrelia DbpA
NLLKLTILVNL

SEQ ID NO: 2938 - protein, 11 aa, Borrelia DbpA
ILVNLLISCGL

SEQ ID NO: 2939 - protein, 11 aa, Borrelia DbpA
FSAMYDLMFEV

SEQ ID NO: 2940 - protein, 11 aa, Borrelia DbpA
SAMYDLMFEVS

SEQ ID NO: 2941 - protein, 11 aa, Borrelia DbpA
AMYDLMFEVSK

SEQ ID NO: 2942 - protein, 11 aa, Borrelia DbpA
YDLMFEVSKPL

SEQ ID NO: 2943 - protein, 11 aa, Borrelia DbpA
FKELYELMLKI

SEQ ID NO: 2944 - protein, 11 aa, Borrelia DbpA
FNNLLKLTILV

SEQ ID NO: 2945 - protein, 11 aa, Borrelia DbpA
NLLKLTILVNL

SEQ ID NO: 2946 - protein, 11 aa, Borrelia DbpA
ILVNLLISCGL

SEQ ID NO: 2947 - protein, 11 aa, Borrelia DbpA
FSAMYDLMFEV

SEQ ID NO: 2948 - protein, 11 aa, Borrelia DbpA
SAMYDLMFEVS

SEQ ID NO: 2949 - protein, 11 aa, Borrelia DbpA
AMYDLMFEVSK

SEQ ID NO: 2950 - protein, 11 aa, Borrelia DbpA
YDLMFEVSKPL

SEQ ID NO: 2951 - protein, 12 aa, Borrelia DbpA
KIILTLTLLASL

SEQ ID NO: 2952 - protein, 12 aa, Borrelia DbpA
TLLASLLAACSL

SEQ ID NO: 2953 - protein, 12 aa, Borrelia DbpA
EFSGIYDLILNA

SEQ ID NO: 2954 - protein, 12 aa, Borrelia DbpA
DFSGIYDLILNA

SEQ ID NO: 2955 - protein, 12 aa, Borrelia DbpA
AFSAMYDLMLDV

SEQ ID NO: 2956 - protein, 12 aa, Borrelia DbpA
FSAMYDLMLDVS

SEQ ID NO: 2957 - protein, 12 aa, Borrelia DbpA
MYDLMLDVSKPL

SEQ ID NO: 2958 - protein, 12 aa, Borrelia DbpA
LMLDVSKPLEEI

SEQ ID NO: 2959 - protein, 12 aa, Borrelia DbpA
YIKNLLKLTLIV

SEQ ID NO: 2960 - protein, 12 aa, Borrelia DbpA
KNLLKLTLIVGL

SEQ ID NO: 2961 - protein, 12 aa, Borrelia DbpA
LLKDMYDLMLNA

SEQ ID NO: 2962 - protein, 12 aa, Borrelia DbpA
KNLLKLSLIVSL

SEQ ID NO: 2963 - protein, 12 aa, Borrelia DbpA
LLKLSLIVSLLV

SEQ ID NO: 2964 - protein, 12 aa, Borrelia DbpA
KIILTLTLLASL

SEQ ID NO: 2965 - protein, 12 aa, Borrelia DbpA
TLLASLLAACSL

SEQ ID NO: 2966 - protein, 12 aa, Borrelia DbpA
KKLVADLTIEFL

SEQ ID NO: 2967 - protein, 12 aa, Borrelia DbpA
KNLLKLSLIVSL

SEQ ID NO: 2968 - protein, 12 aa, Borrelia DbpA
LLKLSLIVSLLV

SEQ ID NO: 2969 - protein, 12 aa, Borrelia DbpA
AFSAMYDLMLDV

SEQ ID NO: 2970 - protein, 12 aa, Borrelia DbpA
FSAMYDLMLDVS

SEQ ID NO: 2971 - protein, 12 aa, Borrelia DbpA
MYDLMLDVSKPL

SEQ ID NO: 2972 - protein, 12 aa, Borrelia DbpA
LMLDVSKPLEEI

SEQ ID NO: 2973 - protein, 12 aa, Borrelia DbpA
TFNNLLKLTILV

SEQ ID NO: 2974 - protein, 12 aa, Borrelia DbpA
FNNLLKLTILVN

SEQ ID NO: 2975 - protein, 12 aa, Borrelia DbpA
NNLLKLTILVNL

SEQ ID NO: 2976 - protein, 12 aa, Borrelia DbpA
TILVNLLISCGL

SEQ ID NO: 2977 - protein, 12 aa, Borrelia DbpA
FILEAKVRATTV

SEQ ID NO: 2978 - protein, 12 aa, Borrelia DbpA
EFSAMYDLMFEV

SEQ ID NO: 2979 - protein, 12 aa, Borrelia DbpA
FSAMYDLMFEVS

SEQ ID NO: 2980 - protein, 12 aa, Borrelia DbpA
SAMYDLMFEVSK

SEQ ID NO: 2981 - protein, 12 aa, Borrelia DbpA
AMYDLMFEVSKP

SEQ ID NO: 2982 - protein, 12 aa, Borrelia DbpA
MYDLMFEVSKPL

SEQ ID NO: 2983 - protein, 12 aa, Borrelia DbpA
YDLMFEVSKPLQ

SEQ ID NO: 2984 - protein, 12 aa, Borrelia DbpA
LMFEVSKPLQKL

SEQ ID NO: 2985 - protein, 12 aa, Borrelia DbpA
EFKELYELMLKI

SEQ ID NO: 2986 - protein, 12 aa, Borrelia DbpA
FKELYELMLKIS

SEQ ID NO: 2987 - protein, 12 aa, Borrelia DbpA
TFNNLLKLTILV

SEQ ID NO: 2988 - protein, 12 aa, Borrelia DbpA
FNNLLKLTILVN

SEQ ID NO: 2989 - protein, 12 aa, Borrelia DbpA
NNLLKLTILVNL

SEQ ID NO: 2990 - protein, 12 aa, Borrelia DbpA
TILVNLLISCGL

SEQ ID NO: 2991 - protein, 12 aa, Borrelia DbpA
EFSAMYDLMFEV

SEQ ID NO: 2992 - protein, 12 aa, Borrelia DbpA
FSAMYDLMFEVS

SEQ ID NO: 2993 - protein, 12 aa, Borrelia DbpA
SAMYDLMFEVSK

SEQ ID NO: 2994 - protein, 12 aa, Borrelia DbpA
AMYDLMFEVSKP

SEQ ID NO: 2995 - protein, 12 aa, Borrelia DbpA
MYDLMFEVSKPL

SEQ ID NO: 2996 - protein, 12 aa, Borrelia DbpA
YDLMFEVSKPLQ

SEQ ID NO: 2997 - protein, 12 aa, Borrelia DbpA
LMFEVSKPLQEL

SEQ ID NO: 2998 - protein, 9 aa, Borrelia DbpA
LAACSLTGK

SEQ ID NO: 2999 - protein, 9 aa, Borrelia DbpA
KARLESSVK

SEQ ID NO: 3000 - protein, 9 aa, Borrelia DbpA
KAVEKIGMK

SEQ ID NO: 3001 - protein, 9 aa, Borrelia DbpA
KIGMKDMTK

SEQ ID NO: 3002 - protein, 9 aa, Borrelia DbpA
IIAIVKVMK

SEQ ID NO: 3003 - protein, 9 aa, Borrelia DbpA
AIVKVMKAK

SEQ ID NO: 3004 - protein, 9 aa, Borrelia DbpA
KQTGSKVSK

SEQ ID NO: 3005 - protein, 9 aa, Borrelia DbpA
QTGSKVSKK

SEQ ID NO: 3006 - protein, 9 aa, Borrelia DbpA
IQAIQVAGK

SEQ ID NO: 3007 - protein, 9 aa, Borrelia DbpA
IQVAGKFVK

SEQ ID NO: 3008 - protein, 9 aa, Borrelia DbpA
GTVTQAAEK

SEQ ID NO: 3009 - protein, 9 aa, Borrelia DbpA
AIAKAMEDK

SEQ ID NO: 3010 - protein, 9 aa, Borrelia DbpA
LVACSLTGK

SEQ ID NO: 3011 - protein, 9 aa, Borrelia DbpA
KLNELEENK

SEQ ID NO: 3012 - protein, 9 aa, Borrelia DbpA
KVDKDQLLK

SEQ ID NO: 3013 - protein, 9 aa, Borrelia DbpA
KLGLQEMIK

SEQ ID NO: 3014 - protein, 9 aa, Borrelia DbpA
KTVTQAAEK

SEQ ID NO: 3015 - protein, 9 aa, Borrelia DbpA
MIANTIEDK

SEQ ID NO: 3016 - protein, 9 aa, Borrelia DbpA
QTGSKVSEK

SEQ ID NO: 3017 - protein, 9 aa, Borrelia DbpA
GTVTQVAEK

SEQ ID NO: 3018 - protein, 9 aa, Borrelia DbpA
LAACSLTGK

SEQ ID NO: 3019 - protein, 9 aa, Borrelia DbpA
KARLESSVK

SEQ ID NO: 3020 - protein, 9 aa, Borrelia DbpA
IIAIVKVMK

SEQ ID NO: 3021 - protein, 9 aa, Borrelia DbpA
AIVKVMKAK

SEQ ID NO: 3022 - protein, 9 aa, Borrelia DbpA
QTGSKVSEK

SEQ ID NO: 3023 - protein, 9 aa, Borrelia DbpA
AIAQAMEEK

SEQ ID NO: 3024 - protein, 9 aa, Borrelia DbpA
KIRLERSAK

SEQ ID NO: 3025 - protein, 9 aa, Borrelia DbpA
AIKKDAALK

SEQ ID NO: 3026 - protein, 9 aa, Borrelia DbpA
KLGIQEMTK

SEQ ID NO: 3027 - protein, 9 aa, Borrelia DbpA
HTKNYCTLK

SEQ ID NO: 3028 - protein, 9 aa, Borrelia DbpA
KNYCTLKKK

SEQ ID NO: 3029 - protein, 9 aa, Borrelia DbpA
KARLESSVK

SEQ ID NO: 3030 - protein, 9 aa, Borrelia DbpA
IALTLQFLK

SEQ ID NO: 3031 - protein, 9 aa, Borrelia DbpA
KELYELMLK

SEQ ID NO: 3032 - protein, 9 aa, Borrelia DbpA
GLTGATKIK

SEQ ID NO: 3033 - protein, 9 aa, Borrelia DbpA
KIKLESSAK

SEQ ID NO: 3034 - protein, 9 aa, Borrelia DbpA
LIRVKGKQK

SEQ ID NO: 3035 - protein, 10 aa, Borrelia DbpA
LLAACSLTGK

SEQ ID NO: 3036 - protein, 10 aa, Borrelia DbpA
ITNEIEKAIK

SEQ ID NO: 3037 - protein, 10 aa, Borrelia DbpA
KIRVADLTIK

SEQ ID NO: 3038 - protein, 10 aa, Borrelia DbpA
ATEEETITFK

SEQ ID NO: 3039 - protein, 10 aa, Borrelia DbpA
ILNAAKAVEK

SEQ ID NO: 3040 - protein, 10 aa, Borrelia DbpA
MTKTVEEAAK

SEQ ID NO: 3041 - protein, 10 aa, Borrelia DbpA
TANGIIEIVK

SEQ ID NO: 3042 - protein, 10 aa, Borrelia DbpA
GIIEIVKVMK

SEQ ID NO: 3043 - protein, 10 aa, Borrelia DbpA
IEIVKVMKAK

SEQ ID NO: 3044 - protein, 10 aa, Borrelia DbpA
VMKAKVENIK

SEQ ID NO: 3045 - protein, 10 aa, Borrelia DbpA
GIIAIVKVMK

SEQ ID NO: 3046 - protein, 10 aa, Borrelia DbpA
IAIVKVMKAK

SEQ ID NO: 3047 - protein, 10 aa, Borrelia DbpA
MTKHTKNLIK

SEQ ID NO: 3048 - protein, 10 aa, Borrelia DbpA
KLESSAQEIK

SEQ ID NO: 3049 - protein, 10 aa, Borrelia DbpA
GVNFEAFTDK

SEQ ID NO: 3050 - protein, 10 aa, Borrelia DbpA
AFTDKQTGSK

SEQ ID NO: 3051 - protein, 10 aa, Borrelia DbpA
KQTGSKVSKK

SEQ ID NO: 3052 - protein, 10 aa, Borrelia DbpA
VSKKPEFILK

SEQ ID NO: 3053 - protein, 10 aa, Borrelia DbpA
KIQAIQVAGK

SEQ ID NO: 3054 - protein, 10 aa, Borrelia DbpA
AIQVAGKFVK

SEQ ID NO: 3055 - protein, 10 aa, Borrelia DbpA
KPLEEIGIQK

SEQ ID NO: 3056 - protein, 10 aa, Borrelia DbpA
LAIAKAMEDK

SEQ ID NO: 3057 - protein, 10 aa, Borrelia DbpA
MTKYIKNLLK

SEQ ID NO: 3058 - protein, 10 aa, Borrelia DbpA
LLVACSLTGK

SEQ ID NO: 3059 - protein, 10 aa, Borrelia DbpA
KIRVINLSVK

SEQ ID NO: 3060 - protein, 10 aa, Borrelia DbpA
VINLSVKFLK

SEQ ID NO: 3061 - protein, 10 aa, Borrelia DbpA
ILKDNVGMNK

SEQ ID NO: 3062 - protein, 10 aa, Borrelia DbpA
NKVDKDQLLK

SEQ ID NO: 3063 - protein, 10 aa, Borrelia DbpA
MLNAAGSLQK

SEQ ID NO: 3064 - protein, 10 aa, Borrelia DbpA
IKTVTQAAEK

SEQ ID NO: 3065 - protein, 10 aa, Borrelia DbpA
LMIANTIEDK

SEQ ID NO: 3066 - protein, 10 aa, Borrelia DbpA
KIKGKQETNK

SEQ ID NO: 3067 - protein, 10 aa, Borrelia DbpA
RLESSAQEIK

SEQ ID NO: 3068 - protein, 10 aa, Borrelia DbpA
KANAKKEGVK

SEQ ID NO: 3069 - protein, 10 aa, Borrelia DbpA
GVKFEAFTDK

SEQ ID NO: 3070 - protein, 10 aa, Borrelia DbpA
AFTDKQTGSK

SEQ ID NO: 3071 - protein, 10 aa, Borrelia DbpA
KQTGSKVSEK

SEQ ID NO: 3072 - protein, 10 aa, Borrelia DbpA
VSEKPEFILK

SEQ ID NO: 3073 - protein, 10 aa, Borrelia DbpA
KIQAIQVAEK

SEQ ID NO: 3074 - protein, 10 aa, Borrelia DbpA
AIQVAEKFVK

SEQ ID NO: 3075 - protein, 10 aa, Borrelia DbpA
KPLEEIGIQK

SEQ ID NO: 3076 - protein, 10 aa, Borrelia DbpA
LAIAQAMEDK

SEQ ID NO: 3077 - protein, 10 aa, Borrelia DbpA
KQHEALKNLK

SEQ ID NO: 3078 - protein, 10 aa, Borrelia DbpA
LLAACSLTGK

SEQ ID NO: 3079 - protein, 10 aa, Borrelia DbpA
ITNEIDKAIK

SEQ ID NO: 3080 - protein, 10 aa, Borrelia DbpA
VADLTIEFLK

SEQ ID NO: 3081 - protein, 10 aa, Borrelia DbpA
ATEEETITFK

SEQ ID NO: 3082 - protein, 10 aa, Borrelia DbpA
AVEKIGMKVK

SEQ ID NO: 3083 - protein, 10 aa, Borrelia DbpA
TANGIIAIVK

SEQ ID NO: 3084 - protein, 10 aa, Borrelia DbpA
GIIAIVKVMK

SEQ ID NO: 3085 - protein, 10 aa, Borrelia DbpA
IAIVKVMKAK

SEQ ID NO: 3086 - protein, 10 aa, Borrelia DbpA
VMKAKVENIK

SEQ ID NO: 3087 - protein, 10 aa, Borrelia DbpA
RLESSAQEIK

SEQ ID NO: 3088 - protein, 10 aa, Borrelia DbpA
KANAKKEGVK

SEQ ID NO: 3089 - protein, 10 aa, Borrelia DbpA
GVKFEAFTDK

SEQ ID NO: 3090 - protein, 10 aa, Borrelia DbpA
AFTDKQTGSK

SEQ ID NO: 3091 - protein, 10 aa, Borrelia DbpA
KQTGSKVSEK

SEQ ID NO: 3092 - protein, 10 aa, Borrelia DbpA
VSEKPEFILK

SEQ ID NO: 3093 - protein, 10 aa, Borrelia DbpA
KIKAIQVAEK

SEQ ID NO: 3094 - protein, 10 aa, Borrelia DbpA
AIQVAEKFVK

SEQ ID NO: 3095 - protein, 10 aa, Borrelia DbpA
KPLEEIGIQK

SEQ ID NO: 3096 - protein, 10 aa, Borrelia DbpA
IQKMTGTVTK

SEQ ID NO: 3097 - protein, 10 aa, Borrelia DbpA
LAIAQAMEEK

SEQ ID NO: 3098 - protein, 10 aa, Borrelia DbpA
ISCGLTGATK

SEQ ID NO: 3099 - protein, 10 aa, Borrelia DbpA
TKIRLERSAK

SEQ ID NO: 3100 - protein, 10 aa, Borrelia DbpA
GVNFDAFKDK

SEQ ID NO: 3101 - protein, 10 aa, Borrelia DbpA
KVRATTVAEK

SEQ ID NO: 3102 - protein, 10 aa, Borrelia DbpA
QKLGIQEMTK

SEQ ID NO: 3103 - protein, 10 aa, Borrelia DbpA
LEIAKKMREK

SEQ ID NO: 3104 - protein, 10 aa, Borrelia DbpA
KLQRVHTKNY

SEQ ID NO: 3105 - protein, 10 aa, Borrelia DbpA
VHTKNYCTLK

SEQ ID NO: 3106 - protein, 10 aa, Borrelia DbpA
HTKNYCTLKK

SEQ ID NO: 3107 - protein, 10 aa, Borrelia DbpA
ITNEIDKAIK

SEQ ID NO: 3108 - protein, 10 aa, Borrelia DbpA
VDTNAFTDQK

SEQ ID NO: 3109 - protein, 10 aa, Borrelia DbpA
KTGAKMGGPK

SEQ ID NO: 3110 - protein, 10 aa, Borrelia DbpA
IIALTLQFLK

SEQ ID NO: 3111 - protein, 10 aa, Borrelia DbpA
ISCGLTGATK

SEQ ID NO: 3112 - protein, 10 aa, Borrelia DbpA
TKIKLESSAK

SEQ ID NO: 3113 - protein, 10 aa, Borrelia DbpA
IVDEIDAIKK

SEQ ID NO: 3114 - protein, 10 aa, Borrelia DbpA
AFTDSATGGK

SEQ ID NO: 3115 - protein, 10 aa, Borrelia DbpA
KVARSGSESR

SEQ ID NO: 3116 - protein, 10 aa, Borrelia DbpA
SESRAGNFIK

SEQ ID NO: 3117 - protein, 10 aa, Borrelia DbpA
RAGNFIKQAK

SEQ ID NO: 3118 - protein, 10 aa, Borrelia DbpA
KVRAIDTAEK

SEQ ID NO: 3119 - protein, 10 aa, Borrelia DbpA
MTKEVSDAAK

SEQ ID NO: 3120 - protein, 10 aa, Borrelia DbpA
LEIAKKMREK

SEQ ID NO: 3121 - protein, 10 aa, Borrelia DbpA
KMREKLIRVK

SEQ ID NO: 3122 - protein, 10 aa, Borrelia DbpA
KLIRVKGKQK

SEQ ID NO: 3123 - protein, 10 aa, Borrelia DbpA
KQKLNPETNK

SEQ ID NO: 3124 - protein, 11 aa, Borrelia DbpA
SLLAACSLTGK

SEQ ID NO: 3125 - protein, 11 aa, Borrelia DbpA
LLAACSLTGKA

SEQ ID NO: 3126 - protein, 11 aa, Borrelia DbpA
KVAGPKIRAAK

SEQ ID NO: 3127 - protein, 11 aa, Borrelia DbpA
GIYDLILNAAK

SEQ ID NO: 3128 - protein, 11 aa, Borrelia DbpA
KVMKAKVENIK

SEQ ID NO: 3129 - protein, 11 aa, Borrelia DbpA
KVGGSQIRAAK

SEQ ID NO: 3130 - protein, 11 aa, Borrelia DbpA
KVSKKPEFILK

SEQ ID NO: 3131 - protein, 11 aa, Borrelia DbpA
AMYDLMLDVSK

SEQ ID NO: 3132 - protein, 11 aa, Borrelia DbpA
MTKYIKNLLKL

SEQ ID NO: 3133 - protein, 11 aa, Borrelia DbpA
GLLVACSLTGK

SEQ ID NO: 3134 - protein, 11 aa, Borrelia DbpA
AKIRVINLSVK

SEQ ID NO: 3135 - protein, 11 aa, Borrelia DbpA
RVINLSVKFLK

SEQ ID NO: 3136 - protein, 11 aa, Borrelia DbpA
NILKDNVGMNK

SEQ ID NO: 3137 - protein, 11 aa, Borrelia DbpA
LMLNAAGSLQK

SEQ ID NO: 3138 - protein, 11 aa, Borrelia DbpA
MLNAAGSLQKL

SEQ ID NO: 3139 - protein, 11 aa, Borrelia DbpA
ILMIANTIEDK

SEQ ID NO: 3140 - protein, 11 aa, Borrelia DbpA
MIANTIEDKLK

SEQ ID NO: 3141 - protein, 11 aa, Borrelia DbpA
MTKYIKKNLLK

SEQ ID NO: 3142 - protein, 11 aa, Borrelia DbpA
KVSEKPEFILK

SEQ ID NO: 3143 - protein, 11 aa, Borrelia DbpA
AMYDLMLDVSK

SEQ ID NO: 3144 - protein, 11 aa, Borrelia DbpA
ILAIAQAMEDK

SEQ ID NO: 3145 - protein, 11 aa, Borrelia DbpA
SLLAACSLTGK

SEQ ID NO: 3146 - protein, 11 aa, Borrelia DbpA
LLAACSLTGKA

SEQ ID NO: 3147 - protein, 11 aa, Borrelia DbpA
KVAGSQIRDAK

SEQ ID NO: 3148 - protein, 11 aa, Borrelia DbpA
LIYRTAEAVEK

SEQ ID NO: 3149 - protein, 11 aa, Borrelia DbpA
KVMKAKVENIK

SEQ ID NO: 3150 - protein, 11 aa, Borrelia DbpA
MTKYIKKNLLK

SEQ ID NO: 3151 - protein, 11 aa, Borrelia DbpA
KVSEKPEFILK

SEQ ID NO: 3152 - protein, 11 aa, Borrelia DbpA
AKIKAIQVAEK

SEQ ID NO: 3153 - protein, 11 aa, Borrelia DbpA
AMYDLMLDVSK

SEQ ID NO: 3154 - protein, 11 aa, Borrelia DbpA
GIQKMTGTVTK

SEQ ID NO: 3155 - protein, 11 aa, Borrelia DbpA
ILAIAQAMEEK

SEQ ID NO: 3156 - protein, 11 aa, Borrelia DbpA
ALKGVNFDAFK

SEQ ID NO: 3157 - protein, 11 aa, Borrelia DbpA
AKVRATTVAEK

SEQ ID NO: 3158 - protein, 11 aa, Borrelia DbpA
KVRATTVAEKF

SEQ ID NO: 3159 - protein, 11 aa, Borrelia DbpA
AMYDLMFEVSK

SEQ ID NO: 3160 - protein, 11 aa, Borrelia DbpA
LMFEVSKPLQK

SEQ ID NO: 3161 - protein, 11 aa, Borrelia DbpA
RVHTKNYCTLK

SEQ ID NO: 3162 - protein, 11 aa, Borrelia DbpA
HTKNYCTLKKK

SEQ ID NO: 3163 - protein, 11 aa, Borrelia DbpA
KMGGPKTREAK

SEQ ID NO: 3164 - protein, 11 aa, Borrelia DbpA
RIIALTLQFLK

SEQ ID NO: 3165 - protein, 11 aa, Borrelia DbpA
IIALTLQFLKE

SEQ ID NO: 3166 - protein, 11 aa, Borrelia DbpA
AKVRAIDTAEK

SEQ ID NO: 3167 - protein, 11 aa, Borrelia DbpA
AMYDLMFEVSK

SEQ ID NO: 3168 - protein, 11 aa, Borrelia DbpA
KKMREKLIRVK

SEQ ID NO: 3169 - protein, 11 aa, Borrelia DbpA
KMREKLIRVKG

SEQ ID NO: 3170 - protein, 12 aa, Borrelia DbpA
ASLLAACSLTGK

SEQ ID NO: 3171 - protein, 12 aa, Borrelia DbpA
SLLAACSLTGKA

SEQ ID NO: 3172 - protein, 12 aa, Borrelia DbpA
GKVAGPKIRAAK

SEQ ID NO: 3173 - protein, 12 aa, Borrelia DbpA
KVAGPKIRAAKI

SEQ ID NO: 3174 - protein, 12 aa, Borrelia DbpA
SGIYDLILNAAK

SEQ ID NO: 3175 - protein, 12 aa, Borrelia DbpA
GIYDLILNAAKA

SEQ ID NO: 3176 - protein, 12 aa, Borrelia DbpA
VKVMKAKVENIK

SEQ ID NO: 3177 - protein, 12 aa, Borrelia DbpA
KTTADGIIAIVK

SEQ ID NO: 3178 - protein, 12 aa, Borrelia DbpA
SKVSKKPEFILK

SEQ ID NO: 3179 - protein, 12 aa, Borrelia DbpA
KVSKKPEFILKA

SEQ ID NO: 3180 - protein, 12 aa, Borrelia DbpA
SAMYDLMLDVSK

SEQ ID NO: 3181 - protein, 12 aa, Borrelia DbpA
AMYDLMLDVSKP

SEQ ID NO: 3182 - protein, 12 aa, Borrelia DbpA
KMTGTVTQAAEK

SEQ ID NO: 3183 - protein, 12 aa, Borrelia DbpA
AMEDKLNNVNTK

SEQ ID NO: 3184 - protein, 12 aa, Borrelia DbpA
MTKYIKNLLKLT

SEQ ID NO: 3185 - protein, 12 aa, Borrelia DbpA
VGLLVACSLTGK

SEQ ID NO: 3186 - protein, 12 aa, Borrelia DbpA
DAKIRVINLSVK

SEQ ID NO: 3187 - protein, 12 aa, Borrelia DbpA
IRVINLSVKFLK

SEQ ID NO: 3188 - protein, 12 aa, Borrelia DbpA
RVINLSVKFLKE

SEQ ID NO: 3189 - protein, 12 aa, Borrelia DbpA
ANILKDNVGMNK

SEQ ID NO: 3190 - protein, 12 aa, Borrelia DbpA
GMNKVDKDQLLK

SEQ ID NO: 3191 - protein, 12 aa, Borrelia DbpA
DLMLNAAGSLQK

SEQ ID NO: 3192 - protein, 12 aa, Borrelia DbpA
LMLNAAGSLQKL

SEQ ID NO: 3193 - protein, 12 aa, Borrelia DbpA
MLNAAGSLQKLG

SEQ ID NO: 3194 - protein, 12 aa, Borrelia DbpA
LMIANTIEDKLK

SEQ ID NO: 3195 - protein, 12 aa, Borrelia DbpA
MIANTIEDKLKK

SEQ ID NO: 3196 - protein, 12 aa, Borrelia DbpA
LLVACGLTGETK

SEQ ID NO: 3197 - protein, 12 aa, Borrelia DbpA
KIRLESSAQEIK

SEQ ID NO: 3198 - protein, 12 aa, Borrelia DbpA
SKVSEKPEFILK

SEQ ID NO: 3199 - protein, 12 aa, Borrelia DbpA
SAMYDLMLDVSK

SEQ ID NO: 3200 - protein, 12 aa, Borrelia DbpA
AMYDLMLDVSKP

SEQ ID NO: 3201 - protein, 12 aa, Borrelia DbpA
KMTGTVTQVAEK

SEQ ID NO: 3202 - protein, 12 aa, Borrelia DbpA
ASLLAACSLTGK

SEQ ID NO: 3203 - protein, 12 aa, Borrelia DbpA
SLLAACSLTGKA

SEQ ID NO: 3204 - protein, 12 aa, Borrelia DbpA
GKVAGSQIRDAK

SEQ ID NO: 3205 - protein, 12 aa, Borrelia DbpA
KVAGSQIRDAKK

SEQ ID NO: 3206 - protein, 12 aa, Borrelia DbpA
KLVADLTIEFLK

SEQ ID NO: 3207 - protein, 12 aa, Borrelia DbpA
DLIYRTAEAVEK

SEQ ID NO: 3208 - protein, 12 aa, Borrelia DbpA
LIYRTAEAVEKI

SEQ ID NO: 3209 - protein, 12 aa, Borrelia DbpA
RTAEAVEKIGMK

SEQ ID NO: 3210 - protein, 12 aa, Borrelia DbpA
KTTANGIIAIVK

SEQ ID NO: 3211 - protein, 12 aa, Borrelia DbpA
VKVMKAKVENIK

SEQ ID NO: 3212 - protein, 12 aa, Borrelia DbpA
LLVACGLTGETK

SEQ ID NO: 3213 - protein, 12 aa, Borrelia DbpA
KIRLESSAQEIK

SEQ ID NO: 3214 - protein, 12 aa, Borrelia DbpA
SKVSEKPEFILK

SEQ ID NO: 3215 - protein, 12 aa, Borrelia DbpA
SAMYDLMLDVSK

SEQ ID NO: 3216 - protein, 12 aa, Borrelia DbpA
AMYDLMLDVSKP

SEQ ID NO: 3217 - protein, 12 aa, Borrelia DbpA
IGIQKMTGTVTK

SEQ ID NO: 3218 - protein, 12 aa, Borrelia DbpA
KMTGTVTKEAEK

SEQ ID NO: 3219 - protein, 12 aa, Borrelia DbpA
LLISCGLTGATK

SEQ ID NO: 3220 - protein, 12 aa, Borrelia DbpA
AALKGVNFDAFK

SEQ ID NO: 3221 - protein, 12 aa, Borrelia DbpA
ALKGVNFDAFKD

SEQ ID NO: 3222 - protein, 12 aa, Borrelia DbpA
EAKVRATTVAEK

SEQ ID NO: 3223 - protein, 12 aa, Borrelia DbpA
SAMYDLMFEVSK

SEQ ID NO: 3224 - protein, 12 aa, Borrelia DbpA
AMYDLMFEVSKP

SEQ ID NO: 3225 - protein, 12 aa, Borrelia DbpA
DLMFEVSKPLQK

SEQ ID NO: 3226 - protein, 12 aa, Borrelia DbpA
LMFEVSKPLQKL

SEQ ID NO: 3227 - protein, 12 aa, Borrelia DbpA
KMREKLQRVHTK

SEQ ID NO: 3228 - protein, 12 aa, Borrelia DbpA
QRVHTKNYCTLK

SEQ ID NO: 3229 - protein, 12 aa, Borrelia DbpA
RVHTKNYCTLKK

SEQ ID NO: 3230 - protein, 12 aa, Borrelia DbpA
AKMGGPKTREAK

SEQ ID NO: 3231 - protein, 12 aa, Borrelia DbpA
KMGGPKTREAKL

SEQ ID NO: 3232 - protein, 12 aa, Borrelia DbpA
LRIIALTLQFLK

SEQ ID NO: 3233 - protein, 12 aa, Borrelia DbpA
RIIALTLQFLKE

SEQ ID NO: 3234 - protein, 12 aa, Borrelia DbpA
LLISCGLTGATK

SEQ ID NO: 3235 - protein, 12 aa, Borrelia DbpA
QAKVRAIDTAEK

SEQ ID NO: 3236 - protein, 12 aa, Borrelia DbpA
SAMYDLMFEVSK

SEQ ID NO: 3237 - protein, 12 aa, Borrelia DbpA
AMYDLMFEVSKP

SEQ ID NO: 3238 - protein, 12 aa, Borrelia DbpA
AKKMREKLIRVK

SEQ ID NO: 3239 - protein, 12 aa, Borrelia DbpA
KKMREKLIRVKG

SEQ ID NO: 3240 - protein, 12 aa, Borrelia DbpA
KMREKLIRVKGK

SEQ ID NO: 3241 - protein, 9 aa, Borrelia DbpA
LAACSLTGK

SEQ ID NO: 3242 - protein, 9 aa, Borrelia DbpA
KAVEKIGMK

SEQ ID NO: 3243 - protein, 9 aa, Borrelia DbpA
KIGMKDMTK

SEQ ID NO: 3244 - protein, 9 aa, Borrelia DbpA
IIEIVKVMK

SEQ ID NO: 3245 - protein, 9 aa, Borrelia DbpA
KQAVEEAAK

SEQ ID NO: 3246 - protein, 9 aa, Borrelia DbpA
IIAIVKVMK

SEQ ID NO: 3247 - protein, 9 aa, Borrelia DbpA
AIVKVMKAK

SEQ ID NO: 3248 - protein, 9 aa, Borrelia DbpA
FTDKQTGSK

SEQ ID NO: 3249 - protein, 9 aa, Borrelia DbpA
KQTGSKVSK

SEQ ID NO: 3250 - protein, 9 aa, Borrelia DbpA
QTGSKVSKK

SEQ ID NO: 3251 - protein, 9 aa, Borrelia DbpA
IQAIQVAGK

SEQ ID NO: 3252 - protein, 9 aa, Borrelia DbpA
IQVAGKFVK

SEQ ID NO: 3253 - protein, 9 aa, Borrelia DbpA
KAIKEEAEK

SEQ ID NO: 3254 - protein, 9 aa, Borrelia DbpA
SSGAFSAMY

SEQ ID NO: 3255 - protein, 9 aa, Borrelia DbpA
GTVTQAAEK

SEQ ID NO: 3256 - protein, 9 aa, Borrelia DbpA
AIAKAMEDK

SEQ ID NO: 3257 - protein, 9 aa, Borrelia DbpA
LVACSLTGK

SEQ ID NO: 3258 - protein, 9 aa, Borrelia DbpA
KLNELEENK

SEQ ID NO: 3259 - protein, 9 aa, Borrelia DbpA
INLSVKFLK

SEQ ID NO: 3260 - protein, 9 aa, Borrelia DbpA
KVDKDQLLK

SEQ ID NO: 3261 - protein, 9 aa, Borrelia DbpA
KLGLQEMIK

SEQ ID NO: 3262 - protein, 9 aa, Borrelia DbpA
KTVTQAAEK

SEQ ID NO: 3263 - protein, 9 aa, Borrelia DbpA
MIANTIEDK

SEQ ID NO: 3264 - protein, 9 aa, Borrelia DbpA
NTIEDKLKK

SEQ ID NO: 3265 - protein, 9 aa, Borrelia DbpA
KYIKKNLLK

SEQ ID NO: 3266 - protein, 9 aa, Borrelia DbpA
FTDKQTGSK

SEQ ID NO: 3267 - protein, 9 aa, Borrelia DbpA
QTGSKVSEK

SEQ ID NO: 3268 - protein, 9 aa, Borrelia DbpA
IQAIQVAEK

SEQ ID NO: 3269 - protein, 9 aa, Borrelia DbpA
IQVAEKFVK

SEQ ID NO: 3270 - protein, 9 aa, Borrelia DbpA
KAIKEEAEK

SEQ ID NO: 3271 - protein, 9 aa, Borrelia DbpA
SSGAFSAMY

SEQ ID NO: 3272 - protein, 9 aa, Borrelia DbpA
GTVTQVAEK

SEQ ID NO: 3273 - protein, 9 aa, Borrelia DbpA
AIAQAMEDK

SEQ ID NO: 3274 - protein, 9 aa, Borrelia DbpA
LAACSLTGK

SEQ ID NO: 3275 - protein, 9 aa, Borrelia DbpA
GSQIRDAKK

SEQ ID NO: 3276 - protein, 9 aa, Borrelia DbpA
ADLTIEFLK

SEQ ID NO: 3277 - protein, 9 aa, Borrelia DbpA
SGIYDLIYR

SEQ ID NO: 3278 - protein, 9 aa, Borrelia DbpA
IIAIVKVMK

SEQ ID NO: 3279 - protein, 9 aa, Borrelia DbpA
AIVKVMKAK

SEQ ID NO: 3280 - protein, 9 aa, Borrelia DbpA
KYIKKNLLK

SEQ ID NO: 3281 - protein, 9 aa, Borrelia DbpA
FTDKQTGSK

SEQ ID NO: 3282 - protein, 9 aa, Borrelia DbpA
QTGSKVSEK

SEQ ID NO: 3283 - protein, 9 aa, Borrelia DbpA
IQVAEKFVK

SEQ ID NO: 3284 - protein, 9 aa, Borrelia DbpA
KAIKEEAEK

SEQ ID NO: 3285 - protein, 9 aa, Borrelia DbpA
SSGAFSAMY

SEQ ID NO: 3286 - protein, 9 aa, Borrelia DbpA
GTVTKEAEK

SEQ ID NO: 3287 - protein, 9 aa, Borrelia DbpA
AIAQAMEEK

SEQ ID NO: 3288 - protein, 9 aa, Borrelia DbpA
ITDEIDAIK

SEQ ID NO: 3289 - protein, 9 aa, Borrelia DbpA
AIKKDAALK

SEQ ID NO: 3290 - protein, 9 aa, Borrelia DbpA
KGVNFDAFK

SEQ ID NO: 3291 - protein, 9 aa, Borrelia DbpA
IAIEEEATK

SEQ ID NO: 3292 - protein, 9 aa, Borrelia DbpA
SSGEFSAMY

SEQ ID NO: 3293 - protein, 9 aa, Borrelia DbpA
KLGIQEMTK

SEQ ID NO: 3294 - protein, 9 aa, Borrelia DbpA
AQGVLEIAK

SEQ ID NO: 3295 - protein, 9 aa, Borrelia DbpA
HTKNYCTLK

SEQ ID NO: 3296 - protein, 9 aa, Borrelia DbpA
STFTDEKCK

SEQ ID NO: 3297 - protein, 9 aa, Borrelia DbpA
DTNAFTDQK

SEQ ID NO: 3298 - protein, 9 aa, Borrelia DbpA
IALTLQFLK

SEQ ID NO: 3299 - protein, 9 aa, Borrelia DbpA
TLQFLKETK

SEQ ID NO: 3300 - protein, 9 aa, Borrelia DbpA
KELYELMLK

SEQ ID NO: 3301 - protein, 9 aa, Borrelia DbpA
KIKLESSAK

SEQ ID NO: 3302 - protein, 9 aa, Borrelia DbpA
IVDEIDAIK

SEQ ID NO: 3303 - protein, 9 aa, Borrelia DbpA
FTDSATGGK

SEQ ID NO: 3304 - protein, 9 aa, Borrelia DbpA
TAIEEEATK

SEQ ID NO: 3305 - protein, 9 aa, Borrelia DbpA
SSGEFSAMY

SEQ ID NO: 3306 - protein, 9 aa, Borrelia DbpA
AQGVLEIAK

SEQ ID NO: 3307 - protein, 10 aa, Borrelia DbpA
LLAACSLTGK

SEQ ID NO: 3308 - protein, 10 aa, Borrelia DbpA
ITNEIEKAIK

SEQ ID NO: 3309 - protein, 10 aa, Borrelia DbpA
QTGGKVAGPK

SEQ ID NO: 3310 - protein, 10 aa, Borrelia DbpA
VAGPKIRAAK

SEQ ID NO: 3311 - protein, 10 aa, Borrelia DbpA
KIRVADLTIK

SEQ ID NO: 3312 - protein, 10 aa, Borrelia DbpA
ATEEETITFK

SEQ ID NO: 3313 - protein, 10 aa, Borrelia DbpA
ILNAAKAVEK

SEQ ID NO: 3314 - protein, 10 aa, Borrelia DbpA
MTKTVEEAAK

SEQ ID NO: 3315 - protein, 10 aa, Borrelia DbpA
TANGIIEIVK

SEQ ID NO: 3316 - protein, 10 aa, Borrelia DbpA
GIIEIVKVMK

SEQ ID NO: 3317 - protein, 10 aa, Borrelia DbpA
VMKAKVENIK

SEQ ID NO: 3318 - protein, 10 aa, Borrelia DbpA
TADGIIAIVK

SEQ ID NO: 3319 - protein, 10 aa, Borrelia DbpA
GIIAIVKVMK

SEQ ID NO: 3320 - protein, 10 aa, Borrelia DbpA
IAIVKVMKAK

SEQ ID NO: 3321 - protein, 10 aa, Borrelia DbpA
MTKHTKNLIK

SEQ ID NO: 3322 - protein, 10 aa, Borrelia DbpA
VACDLTGETK

SEQ ID NO: 3323 - protein, 10 aa, Borrelia DbpA
GVNFEAFTDK

SEQ ID NO: 3324 - protein, 10 aa, Borrelia DbpA
AFTDKQTGSK

SEQ ID NO: 3325 - protein, 10 aa, Borrelia DbpA
KQTGSKVSKK

SEQ ID NO: 3326 - protein, 10 aa, Borrelia DbpA
VSKKPEFILK

SEQ ID NO: 3327 - protein, 10 aa, Borrelia DbpA
KIQAIQVAGK

SEQ ID NO: 3328 - protein, 10 aa, Borrelia DbpA
AIQVAGKFVK

SEQ ID NO: 3329 - protein, 10 aa, Borrelia DbpA
GSSGAFSAMY

SEQ ID NO: 3330 - protein, 10 aa, Borrelia DbpA
TGTVTQAAEK

SEQ ID NO: 3331 - protein, 10 aa, Borrelia DbpA
TAEGILAIAK

SEQ ID NO: 3332 - protein, 10 aa, Borrelia DbpA
LAIAKAMEDK

SEQ ID NO: 3333 - protein, 10 aa, Borrelia DbpA
MTKYIKNLLK

SEQ ID NO: 3334 - protein, 10 aa, Borrelia DbpA
LLVACSLTGK

SEQ ID NO: 3335 - protein, 10 aa, Borrelia DbpA
KIRVINLSVK

SEQ ID NO: 3336 - protein, 10 aa, Borrelia DbpA
VINLSVKFLK

SEQ ID NO: 3337 - protein, 10 aa, Borrelia DbpA
ILKDNVGMNK

SEQ ID NO: 3338 - protein, 10 aa, Borrelia DbpA
MLNAAGSLQK

SEQ ID NO: 3339 - protein, 10 aa, Borrelia DbpA
IKTVTQAAEK

SEQ ID NO: 3340 - protein, 10 aa, Borrelia DbpA
LMIANTIEDK

SEQ ID NO: 3341 - protein, 10 aa, Borrelia DbpA
IANTIEDKLK

SEQ ID NO: 3342 - protein, 10 aa, Borrelia DbpA
ANTIEDKLKK

SEQ ID NO: 3343 - protein, 10 aa, Borrelia DbpA
VACGLTGETK

SEQ ID NO: 3344 - protein, 10 aa, Borrelia DbpA
RLESSAQEIK

SEQ ID NO: 3345 - protein, 10 aa, Borrelia DbpA
GVKFEAFTDK

SEQ ID NO: 3346 - protein, 10 aa, Borrelia DbpA
AFTDKQTGSK

SEQ ID NO: 3347 - protein, 10 aa, Borrelia DbpA
KQTGSKVSEK

SEQ ID NO: 3348 - protein, 10 aa, Borrelia DbpA
VSEKPEFILK

SEQ ID NO: 3349 - protein, 10 aa, Borrelia DbpA
KIQAIQVAEK

SEQ ID NO: 3350 - protein, 10 aa, Borrelia DbpA
AIQVAEKFVK

SEQ ID NO: 3351 - protein, 10 aa, Borrelia DbpA
GSSGAFSAMY

SEQ ID NO: 3352 - protein, 10 aa, Borrelia DbpA
TGTVTQVAEK

SEQ ID NO: 3353 - protein, 10 aa, Borrelia DbpA
LAIAQAMEDK

SEQ ID NO: 3354 - protein, 10 aa, Borrelia DbpA
IAQAMEDKLK

SEQ ID NO: 3355 - protein, 10 aa, Borrelia DbpA
KQHEALKNLK

SEQ ID NO: 3356 - protein, 10 aa, Borrelia DbpA
LLAACSLTGK

SEQ ID NO: 3357 - protein, 10 aa, Borrelia DbpA
ITNEIDKAIK

SEQ ID NO: 3358 - protein, 10 aa, Borrelia DbpA
VADLTIEFLK

SEQ ID NO: 3359 - protein, 10 aa, Borrelia DbpA
ATEEETITFK

SEQ ID NO: 3360 - protein, 10 aa, Borrelia DbpA
FSGIYDLIYR

SEQ ID NO: 3361 - protein, 10 aa, Borrelia DbpA
AVEKIGMKVK

SEQ ID NO: 3362 - protein, 10 aa, Borrelia DbpA
TANGIIAIVK

SEQ ID NO: 3363 - protein, 10 aa, Borrelia DbpA
GIIAIVKVMK

SEQ ID NO: 3364 - protein, 10 aa, Borrelia DbpA
IAIVKVMKAK

SEQ ID NO: 3365 - protein, 10 aa, Borrelia DbpA
VMKAKVENIK

SEQ ID NO: 3366 - protein, 10 aa, Borrelia DbpA
VACGLTGETK

SEQ ID NO: 3367 - protein, 10 aa, Borrelia DbpA
RLESSAQEIK

SEQ ID NO: 3368 - protein, 10 aa, Borrelia DbpA
GVKFEAFTDK

SEQ ID NO: 3369 - protein, 10 aa, Borrelia DbpA
AFTDKQTGSK

SEQ ID NO: 3370 - protein, 10 aa, Borrelia DbpA
KQTGSKVSEK

SEQ ID NO: 3371 - protein, 10 aa, Borrelia DbpA
VSEKPEFILK

SEQ ID NO: 3372 - protein, 10 aa, Borrelia DbpA
KIKAIQVAEK

SEQ ID NO: 3373 - protein, 10 aa, Borrelia DbpA
AIQVAEKFVK

SEQ ID NO: 3374 - protein, 10 aa, Borrelia DbpA
GSSGAFSAMY

SEQ ID NO: 3375 - protein, 10 aa, Borrelia DbpA
IQKMTGTVTK

SEQ ID NO: 3376 - protein, 10 aa, Borrelia DbpA
TGTVTKEAEK

SEQ ID NO: 3377 - protein, 10 aa, Borrelia DbpA
LAIAQAMEEK

SEQ ID NO: 3378 - protein, 10 aa, Borrelia DbpA
ISCGLTGATK

SEQ ID NO: 3379 - protein, 10 aa, Borrelia DbpA
ITDEIDAIKK

SEQ ID NO: 3380 - protein, 10 aa, Borrelia DbpA
GVNFDAFKDK

SEQ ID NO: 3381 - protein, 10 aa, Borrelia DbpA
SENPFILEAK

SEQ ID NO: 3382 - protein, 10 aa, Borrelia DbpA
KVRATTVAEK

SEQ ID NO: 3383 - protein, 10 aa, Borrelia DbpA
GSSGEFSAMY

SEQ ID NO: 3384 - protein, 10 aa, Borrelia DbpA
TAQGVLEIAK

SEQ ID NO: 3385 - protein, 10 aa, Borrelia DbpA
VHTKNYCTLK

SEQ ID NO: 3386 - protein, 10 aa, Borrelia DbpA
HTKNYCTLKK

SEQ ID NO: 3387 - protein, 10 aa, Borrelia DbpA
ITNEIDKAIK

SEQ ID NO: 3388 - protein, 10 aa, Borrelia DbpA
VDTNAFTDQK

SEQ ID NO: 3389 - protein, 10 aa, Borrelia DbpA
AFTDQKTGAK

SEQ ID NO: 3390 - protein, 10 aa, Borrelia DbpA
KTGAKMGGPK

SEQ ID NO: 3391 - protein, 10 aa, Borrelia DbpA
IIALTLQFLK

SEQ ID NO: 3392 - protein, 10 aa, Borrelia DbpA
IALTLQFLKE

SEQ ID NO: 3393 - protein, 10 aa, Borrelia DbpA
LTLQFLKETK

SEQ ID NO: 3394 - protein, 10 aa, Borrelia DbpA
ISCGLTGATK

SEQ ID NO: 3395 - protein, 10 aa, Borrelia DbpA
TKIKLESSAK

SEQ ID NO: 3396 - protein, 10 aa, Borrelia DbpA
AIVDEIDAIK

SEQ ID NO: 3397 - protein, 10 aa, Borrelia DbpA
IVDEIDAIKK

SEQ ID NO: 3398 - protein, 10 aa, Borrelia DbpA
AFTDSATGGK

SEQ ID NO: 3399 - protein, 10 aa, Borrelia DbpA
SESRAGNFIK

SEQ ID NO: 3400 - protein, 10 aa, Borrelia DbpA
RAGNFIKQAK

SEQ ID NO: 3401 - protein, 10 aa, Borrelia DbpA
KVRAIDTAEK

SEQ ID NO: 3402 - protein, 10 aa, Borrelia DbpA
LTAIEEEATK

SEQ ID NO: 3403 - protein, 10 aa, Borrelia DbpA
GSSGEFSAMY

SEQ ID NO: 3404 - protein, 10 aa, Borrelia DbpA
MTKEVSDAAK

SEQ ID NO: 3405 - protein, 10 aa, Borrelia DbpA
TAQGVLEIAK

SEQ ID NO: 3406 - protein, 10 aa, Borrelia DbpA
KLIRVKGKQK

SEQ ID NO: 3407 - protein, 10 aa, Borrelia DbpA
KQKLNPETNK

SEQ ID NO: 3408 - protein, 11 aa, Borrelia DbpA
SLLAACSLTGK

SEQ ID NO: 3409 - protein, 11 aa, Borrelia DbpA
SVKDITNEIEK

SEQ ID NO: 3410 - protein, 11 aa, Borrelia DbpA
KVAGPKIRAAK

SEQ ID NO: 3411 - protein, 11 aa, Borrelia DbpA
EATEEETITFK

SEQ ID NO: 3412 - protein, 11 aa, Borrelia DbpA
GIYDLILNAAK

SEQ ID NO: 3413 - protein, 11 aa, Borrelia DbpA
TTANGIIEIVK

SEQ ID NO: 3414 - protein, 11 aa, Borrelia DbpA
KVMKAKVENIK

SEQ ID NO: 3415 - protein, 11 aa, Borrelia DbpA
AVEKIGMQGMK

SEQ ID NO: 3416 - protein, 11 aa, Borrelia DbpA
TTADGIIAIVK

SEQ ID NO: 3417 - protein, 11 aa, Borrelia DbpA
DGIIAIVKVMK

SEQ ID NO: 3418 - protein, 11 aa, Borrelia DbpA
EGVNFEAFTDK

SEQ ID NO: 3419 - protein, 11 aa, Borrelia DbpA
KVSKKPEFILK

SEQ ID NO: 3420 - protein, 11 aa, Borrelia DbpA
AKIQAIQVAGK

SEQ ID NO: 3421 - protein, 11 aa, Borrelia DbpA
QAIQVAGKFVK

SEQ ID NO: 3422 - protein, 11 aa, Borrelia DbpA
AMYDLMLDVSK

SEQ ID NO: 3423 - protein, 11 aa, Borrelia DbpA
MTGTVTQAAEK

SEQ ID NO: 3424 - protein, 11 aa, Borrelia DbpA
TTAEGILAIAK

SEQ ID NO: 3425 - protein, 11 aa, Borrelia DbpA
MTKYIKNLLKL

SEQ ID NO: 3426 - protein, 11 aa, Borrelia DbpA
SVKDITDEIDK

SEQ ID NO: 3427 - protein, 11 aa, Borrelia DbpA
RVINLSVKFLK

SEQ ID NO: 3428 - protein, 11 aa, Borrelia DbpA
VINLSVKFLKE

SEQ ID NO: 3429 - protein, 11 aa, Borrelia DbpA
NILKDNVGMNK

SEQ ID NO: 3430 - protein, 11 aa, Borrelia DbpA
LMLNAAGSLQK

SEQ ID NO: 3431 - protein, 11 aa, Borrelia DbpA
ILMIANTIEDK

SEQ ID NO: 3432 - protein, 11 aa, Borrelia DbpA
MIANTIEDKLK

SEQ ID NO: 3433 - protein, 11 aa, Borrelia DbpA
MTKYIKKNLLK

SEQ ID NO: 3434 - protein, 11 aa, Borrelia DbpA
KVSEKPEFILK

SEQ ID NO: 3435 - protein, 11 aa, Borrelia DbpA
AKIQAIQVAEK

SEQ ID NO: 3436 - protein, 11 aa, Borrelia DbpA
AMYDLMLDVSK

SEQ ID NO: 3437 - protein, 11 aa, Borrelia DbpA
MTGTVTQVAEK

SEQ ID NO: 3438 - protein, 11 aa, Borrelia DbpA
SLLAACSLTGK

SEQ ID NO: 3439 - protein, 11 aa, Borrelia DbpA
SVKDITNEIDK

SEQ ID NO: 3440 - protein, 11 aa, Borrelia DbpA
KVAGSQIRDAK

SEQ ID NO: 3441 - protein, 11 aa, Borrelia DbpA
LVADLTIEFLK

SEQ ID NO: 3442 - protein, 11 aa, Borrelia DbpA
KATEEETITFK

SEQ ID NO: 3443 - protein, 11 aa, Borrelia DbpA
LIYRTAEAVEK

SEQ ID NO: 3444 - protein, 11 aa, Borrelia DbpA
TTANGIIAIVK

SEQ ID NO: 3445 - protein, 11 aa, Borrelia DbpA
NGIIAIVKVMK

SEQ ID NO: 3446 - protein, 11 aa, Borrelia DbpA
KVMKAKVENIK

SEQ ID NO: 3447 - protein, 11 aa, Borrelia DbpA
MTKYIKKNLLK

SEQ ID NO: 3448 - protein, 11 aa, Borrelia DbpA
KVSEKPEFILK

SEQ ID NO: 3449 - protein, 11 aa, Borrelia DbpA
KAIQVAEKFVK

SEQ ID NO: 3450 - protein, 11 aa, Borrelia DbpA
AMYDLMLDVSK

SEQ ID NO: 3451 - protein, 11 aa, Borrelia DbpA
GIQKMTGTVTK

SEQ ID NO: 3452 - protein, 11 aa, Borrelia DbpA
MTGTVTKEAEK

SEQ ID NO: 3453 - protein, 11 aa, Borrelia DbpA
ALKGVNFDAFK

SEQ ID NO: 3454 - protein, 11 aa, Borrelia DbpA
KGVNFDAFKDK

SEQ ID NO: 3455 - protein, 11 aa, Borrelia DbpA
GVNFDAFKDKK

SEQ ID NO: 3456 - protein, 11 aa, Borrelia DbpA
VSENPFILEAK

SEQ ID NO: 3457 - protein, 11 aa, Borrelia DbpA
AMYDLMFEVSK

SEQ ID NO: 3458 - protein, 11 aa, Borrelia DbpA
LMFEVSKPLQK

SEQ ID NO: 3459 - protein, 11 aa, Borrelia DbpA
TTAQGVLEIAK

SEQ ID NO: 3460 - protein, 11 aa, Borrelia DbpA
RVHTKNYCTLK

SEQ ID NO: 3461 - protein, 11 aa, Borrelia DbpA
VHTKNYCTLKK

SEQ ID NO: 3462 - protein, 11 aa, Borrelia DbpA
SVKDITNEIDK

SEQ ID NO: 3463 - protein, 11 aa, Borrelia DbpA
GVDTNAFTDQK

SEQ ID NO: 3464 - protein, 11 aa, Borrelia DbpA
RIIALTLQFLK

SEQ ID NO: 3465 - protein, 11 aa, Borrelia DbpA
AIVDEIDAIKK

SEQ ID NO: 3466 - protein, 11 aa, Borrelia DbpA
AMYDLMFEVSK

SEQ ID NO: 3467 - protein, 11 aa, Borrelia DbpA
TTAQGVLEIAK

SEQ ID NO: 3468 - protein, 12 aa, Borrelia DbpA
ASLLAACSLTGK

SEQ ID NO: 3469 - protein, 12 aa, Borrelia DbpA
SSVKDITNEIEK

SEQ ID NO: 3470 - protein, 12 aa, Borrelia DbpA
GKVAGPKIRAAK

SEQ ID NO: 3471 - protein, 12 aa, Borrelia DbpA
LEATEEETITFK

SEQ ID NO: 3472 - protein, 12 aa, Borrelia DbpA
SGIYDLILNAAK

SEQ ID NO: 3473 - protein, 12 aa, Borrelia DbpA
GIYDLILNAAKA

SEQ ID NO: 3474 - protein, 12 aa, Borrelia DbpA
KTVEEAAKENPK

SEQ ID NO: 3475 - protein, 12 aa, Borrelia DbpA
KTTANGIIEIVK

SEQ ID NO: 3476 - protein, 12 aa, Borrelia DbpA
TTANGIIEIVKV

SEQ ID NO: 3477 - protein, 12 aa, Borrelia DbpA
VKVMKAKVENIK

SEQ ID NO: 3478 - protein, 12 aa, Borrelia DbpA
KTTADGIIAIVK

SEQ ID NO: 3479 - protein, 12 aa, Borrelia DbpA
TTADGIIAIVKV

SEQ ID NO: 3480 - protein, 12 aa, Borrelia DbpA
ADGIIAIVKVMK

SEQ ID NO: 3481 - protein, 12 aa, Borrelia DbpA
SSAQEIKDEINK

SEQ ID NO: 3482 - protein, 12 aa, Borrelia DbpA
KEGVNFEAFTDK

SEQ ID NO: 3483 - protein, 12 aa, Borrelia DbpA
SKVSKKPEFILK

SEQ ID NO: 3484 - protein, 12 aa, Borrelia DbpA
KVSKKPEFILKA

SEQ ID NO: 3485 - protein, 12 aa, Borrelia DbpA
KAKIQAIQVAGK

SEQ ID NO: 3486 - protein, 12 aa, Borrelia DbpA
IQAIQVAGKFVK

SEQ ID NO: 3487 - protein, 12 aa, Borrelia DbpA
SAMYDLMLDVSK

SEQ ID NO: 3488 - protein, 12 aa, Borrelia DbpA
AMYDLMLDVSKP

SEQ ID NO: 3489 - protein, 12 aa, Borrelia DbpA
KMTGTVTQAAEK

SEQ ID NO: 3490 - protein, 12 aa, Borrelia DbpA
PTTAEGILAIAK

SEQ ID NO: 3491 - protein, 12 aa, Borrelia DbpA
SSVKDITDEIDK

SEQ ID NO: 3492 - protein, 12 aa, Borrelia DbpA
IRVINLSVKFLK

SEQ ID NO: 3493 - protein, 12 aa, Borrelia DbpA
RVINLSVKFLKE

SEQ ID NO: 3494 - protein, 12 aa, Borrelia DbpA
GMNKVDKDQLLK

SEQ ID NO: 3495 - protein, 12 aa, Borrelia DbpA
DLMLNAAGSLQK

SEQ ID NO: 3496 - protein, 12 aa, Borrelia DbpA
SLQKLGLQEMIK

SEQ ID NO: 3497 - protein, 12 aa, Borrelia DbpA
GILMIANTIEDK

SEQ ID NO: 3498 - protein, 12 aa, Borrelia DbpA
LMIANTIEDKLK

SEQ ID NO: 3499 - protein, 12 aa, Borrelia DbpA
MIANTIEDKLKK

SEQ ID NO: 3500 - protein, 12 aa, Borrelia DbpA
MTKYIKKNLLKL

SEQ ID NO: 3501 - protein, 12 aa, Borrelia DbpA
SSAQEIKDEINK

SEQ ID NO: 3502 - protein, 12 aa, Borrelia DbpA
SKVSEKPEFILK

SEQ ID NO: 3503 - protein, 12 aa, Borrelia DbpA
KVSEKPEFILKA

SEQ ID NO: 3504 - protein, 12 aa, Borrelia DbpA
KAKIQAIQVAEK

SEQ ID NO: 3505 - protein, 12 aa, Borrelia DbpA
SAMYDLMLDVSK

SEQ ID NO: 3506 - protein, 12 aa, Borrelia DbpA
AMYDLMLDVSKP

SEQ ID NO: 3507 - protein, 12 aa, Borrelia DbpA
KMTGTVTQVAEK

SEQ ID NO: 3508 - protein, 12 aa, Borrelia DbpA
LAIAQAMEDKLK

SEQ ID NO: 3509 - protein, 12 aa, Borrelia DbpA
ASLLAACSLTGK

SEQ ID NO: 3510 - protein, 12 aa, Borrelia DbpA
SSVKDITNEIDK

SEQ ID NO: 3511 - protein, 12 aa, Borrelia DbpA
GKVAGSQIRDAK

SEQ ID NO: 3512 - protein, 12 aa, Borrelia DbpA
KVAGSQIRDAKK

SEQ ID NO: 3513 - protein, 12 aa, Borrelia DbpA
KLVADLTIEFLK

SEQ ID NO: 3514 - protein, 12 aa, Borrelia DbpA
LVADLTIEFLKA

SEQ ID NO: 3515 - protein, 12 aa, Borrelia DbpA
LKATEEETITFK

SEQ ID NO: 3516 - protein, 12 aa, Borrelia DbpA
DLIYRTAEAVEK

SEQ ID NO: 3517 - protein, 12 aa, Borrelia DbpA
RTAEAVEKIGMK

SEQ ID NO: 3518 - protein, 12 aa, Borrelia DbpA
KTTANGIIAIVK

SEQ ID NO: 3519 - protein, 12 aa, Borrelia DbpA
TTANGIIAIVKV

SEQ ID NO: 3520 - protein, 12 aa, Borrelia DbpA
ANGIIAIVKVMK

SEQ ID NO: 3521 - protein, 12 aa, Borrelia DbpA
VKVMKAKVENIK

SEQ ID NO: 3522 - protein, 12 aa, Borrelia DbpA
MTKYIKKNLLKL

SEQ ID NO: 3523 - protein, 12 aa, Borrelia DbpA
SSAQEIKDEINK

SEQ ID NO: 3524 - protein, 12 aa, Borrelia DbpA
SKVSEKPEFILK

SEQ ID NO: 3525 - protein, 12 aa, Borrelia DbpA
KVSEKPEFILKA

SEQ ID NO: 3526 - protein, 12 aa, Borrelia DbpA
IKAIQVAEKFVK

SEQ ID NO: 3527 - protein, 12 aa, Borrelia DbpA
SAMYDLMLDVSK

SEQ ID NO: 3528 - protein, 12 aa, Borrelia DbpA
AMYDLMLDVSKP

SEQ ID NO: 3529 - protein, 12 aa, Borrelia DbpA
IGIQKMTGTVTK

SEQ ID NO: 3530 - protein, 12 aa, Borrelia DbpA
GIQKMTGTVTKE

SEQ ID NO: 3531 - protein, 12 aa, Borrelia DbpA
KMTGTVTKEAEK

SEQ ID NO: 3532 - protein, 12 aa, Borrelia DbpA
GILAIAQAMEEK

SEQ ID NO: 3533 - protein, 12 aa, Borrelia DbpA
AALKGVNFDAFK

SEQ ID NO: 3534 - protein, 12 aa, Borrelia DbpA
KGVNFDAFKDKK

SEQ ID NO: 3535 - protein, 12 aa, Borrelia DbpA
GVSENPFILEAK

SEQ ID NO: 3536 - protein, 12 aa, Borrelia DbpA
SAMYDLMFEVSK

SEQ ID NO: 3537 - protein, 12 aa, Borrelia DbpA
AMYDLMFEVSKP

SEQ ID NO: 3538 - protein, 12 aa, Borrelia DbpA
DLMFEVSKPLQK

SEQ ID NO: 3539 - protein, 12 aa, Borrelia DbpA
PTTAQGVLEIAK

SEQ ID NO: 3540 - protein, 12 aa, Borrelia DbpA
TTAQGVLEIAKK

SEQ ID NO: 3541 - protein, 12 aa, Borrelia DbpA
QRVHTKNYCTLK

SEQ ID NO: 3542 - protein, 12 aa, Borrelia DbpA
RVHTKNYCTLKK

SEQ ID NO: 3543 - protein, 12 aa, Borrelia DbpA
SSVKDITNEIDK

SEQ ID NO: 3544 - protein, 12 aa, Borrelia DbpA
GGVDTNAFTDQK

SEQ ID NO: 3545 - protein, 12 aa, Borrelia DbpA
LRIIALTLQFLK

SEQ ID NO: 3546 - protein, 12 aa, Borrelia DbpA
RIIALTLQFLKE

SEQ ID NO: 3547 - protein, 12 aa, Borrelia DbpA
IALTLQFLKETK

SEQ ID NO: 3548 - protein, 12 aa, Borrelia DbpA
KAIVDEIDAIKK

SEQ ID NO: 3549 - protein, 12 aa, Borrelia DbpA
SAMYDLMFEVSK

SEQ ID NO: 3550 - protein, 12 aa, Borrelia DbpA
AMYDLMFEVSKP

SEQ ID NO: 3551 - protein, 12 aa, Borrelia DbpA
PTTAQGVLEIAK

SEQ ID NO: 3552 - protein, 12 aa, Borrelia DbpA
TTAQGVLEIAKK

SEQ ID NO: 3553 - protein, 9 aa, Borrelia DbpA
KYNKIILTL

SEQ ID NO: 3554 - protein, 9 aa, Borrelia DbpA
EFSGIYDLI

SEQ ID NO: 3555 - protein, 9 aa, Borrelia DbpA
DFSGIYDLI

SEQ ID NO: 3556 - protein, 9 aa, Borrelia DbpA
KYIKNLLKL

SEQ ID NO: 3557 - protein, 9 aa, Borrelia DbpA
KYNKIILTL

SEQ ID NO: 3558 - protein, 9 aa, Borrelia DbpA
EFSGIYDLI

SEQ ID NO: 3559 - protein, 9 aa, Borrelia DbpA
RIIALTLQF

SEQ ID NO: 3560 - protein, 10 aa, Borrelia DbpA
IKYNKIILTL

SEQ ID NO: 3561 - protein, 10 aa, Borrelia DbpA
KYNKIILTLT

SEQ ID NO: 3562 - protein, 10 aa, Borrelia DbpA
TKYIKNLLKL

SEQ ID NO: 3563 - protein, 10 aa, Borrelia DbpA
KYIKNLLKLT

SEQ ID NO: 3564 - protein, 10 aa, Borrelia DbpA
KYIKKNLLKL

SEQ ID NO: 3565 - protein, 10 aa, Borrelia DbpA
IKYNKIILTL

SEQ ID NO: 3566 - protein, 10 aa, Borrelia DbpA
KYNKIILTLT

SEQ ID NO: 3567 - protein, 10 aa, Borrelia DbpA
KYIKKNLLKL

SEQ ID NO: 3568 - protein, 10 aa, Borrelia DbpA
EFSAMYDLMF

SEQ ID NO: 3569 - protein, 10 aa, Borrelia DbpA
EFSAMYDLMF

SEQ ID NO: 3570 - protein, 11 aa, Borrelia DbpA
KYNKIILTLTL

SEQ ID NO: 3571 - protein, 11 aa, Borrelia DbpA
KYIKNLLKLTL

SEQ ID NO: 3572 - protein, 12 aa, Borrelia DbpA
IKYNKIILTLTL

SEQ ID NO: 3573 - protein, 12 aa, Borrelia DbpA
KYNKIILTLTLL

SEQ ID NO: 3574 - protein, 12 aa, Borrelia DbpA
TKYIKNLLKLTL

SEQ ID NO: 3575 - protein, 12 aa, Borrelia DbpA
KYIKNLLKLTLI

SEQ ID NO: 3576 - protein, 12 aa, Borrelia DbpA
IKYNKIILTLTL

SEQ ID NO: 3577 - protein, 12 aa, Borrelia DbpA
KYNKIILTLTLL

SEQ ID NO: 3578 - protein, 9 aa, Borrelia DbpA
EIVKVMKAK

SEQ ID NO: 3579 - protein, 9 aa, Borrelia DbpA
EIKDEINKI

SEQ ID NO: 3580 - protein, 9 aa, Borrelia DbpA
TTAEGILAI

SEQ ID NO: 3581 - protein, 9 aa, Borrelia DbpA
EIKDEINKI

SEQ ID NO: 3582 - protein, 9 aa, Borrelia DbpA
TTAEGILAI

SEQ ID NO: 3583 - protein, 9 aa, Borrelia DbpA
EIKDEINKI

SEQ ID NO: 3584 - protein, 9 aa, Borrelia DbpA
TTAEGILAI

SEQ ID NO: 3585 - protein, 9 aa, Borrelia DbpA
ELYELMLKI

SEQ ID NO: 3586 - protein, 9 aa, Borrelia DbpA
QAIQVAGKF

SEQ ID NO: 3587 - protein, 9 aa, Borrelia DbpA
TTAEGILAI

SEQ ID NO: 3588 - protein, 9 aa, Borrelia DbpA
TTVEGILMI

SEQ ID NO: 3589 - protein, 9 aa, Borrelia DbpA
TTAEGILAI

SEQ ID NO: 3590 - protein, 9 aa, Borrelia DbpA
TTAEGILAI

SEQ ID NO: 3591 - protein, 10 aa, Borrelia DbpA
EIVKVMKAKV

SEQ ID NO: 3592 - protein, 10 aa, Borrelia DbpA
DGIIAIVKVM

SEQ ID NO: 3593 - protein, 10 aa, Borrelia DbpA
EAVEKIGMKV

SEQ ID NO: 3594 - protein, 12 aa, Borrelia DbpA
ETGSSGEFSAMY

SEQ ID NO: 3595 - protein, 9 aa, Borrelia DbpA
SSGAFSAMY

SEQ ID NO: 3596 - protein, 9 aa, Borrelia DbpA
AFSAMYDLM

SEQ ID NO: 3597 - protein, 9 aa, Borrelia DbpA
AMYDLMLDV

SEQ ID NO: 3598 - protein, 9 aa, Borrelia DbpA
SSGAFSAMY

SEQ ID NO: 3599 - protein, 9 aa, Borrelia DbpA
AFSAMYDLM

SEQ ID NO: 3600 - protein, 9 aa, Borrelia DbpA
AMYDLMLDV

SEQ ID NO: 3601 - protein, 9 aa, Borrelia DbpA
LVADLTIEF

SEQ ID NO: 3602 - protein, 9 aa, Borrelia DbpA
FSGIYDLIY

SEQ ID NO: 3603 - protein, 9 aa, Borrelia DbpA
SSGAFSAMY

SEQ ID NO: 3604 - protein, 9 aa, Borrelia DbpA
AFSAMYDLM

SEQ ID NO: 3605 - protein, 9 aa, Borrelia DbpA
AMYDLMLDV

SEQ ID NO: 3606 - protein, 9 aa, Borrelia DbpA
SSGEFSAMY

SEQ ID NO: 3607 - protein, 9 aa, Borrelia DbpA
FSAMYDLMF

SEQ ID NO: 3608 - protein, 9 aa, Borrelia DbpA
AMYDLMFEV

SEQ ID NO: 3609 - protein, 9 aa, Borrelia DbpA
RIIALTLQF

SEQ ID NO: 3610 - protein, 9 aa, Borrelia DbpA
SSGEFSAMY

SEQ ID NO: 3611 - protein, 9 aa, Borrelia DbpA
FSAMYDLMF

SEQ ID NO: 3612 - protein, 9 aa, Borrelia DbpA
AMYDLMFEV

SEQ ID NO: 3613 - protein, 10 aa, Borrelia DbpA
GSSGAFSAMY

SEQ ID NO: 3614 - protein, 10 aa, Borrelia DbpA
GSSGAFSAMY

SEQ ID NO: 3615 - protein, 10 aa, Borrelia DbpA
EFSGIYDLIY

SEQ ID NO: 3616 - protein, 10 aa, Borrelia DbpA
GSSGAFSAMY

SEQ ID NO: 3617 - protein, 10 aa, Borrelia DbpA
GSSGEFSAMY

SEQ ID NO: 3618 - protein, 10 aa, Borrelia DbpA
EFSAMYDLMF

SEQ ID NO: 3619 - protein, 10 aa, Borrelia DbpA
GSSGEFSAMY

SEQ ID NO: 3620 - protein, 10 aa, Borrelia DbpA
EFSAMYDLMF

SEQ ID NO: 3621 - protein, 9 aa, Borrelia DbpA
IIAIVKVMK

SEQ ID NO: 3622 - protein, 9 aa, Borrelia DbpA
KQTGSKVSK

SEQ ID NO: 3623 - protein, 9 aa, Borrelia DbpA
IQVAGKFVK

SEQ ID NO: 3624 - protein, 9 aa, Borrelia DbpA
AGKFVKAIK

SEQ ID NO: 3625 - protein, 9 aa, Borrelia DbpA
MTKYIKNLL

SEQ ID NO: 3626 - protein, 9 aa, Borrelia DbpA
INLSVKFLK

SEQ ID NO: 3627 - protein, 9 aa, Borrelia DbpA
KTVTQAAEK

SEQ ID NO: 3628 - protein, 9 aa, Borrelia DbpA
KYIKKNLLK

SEQ ID NO: 3629 - protein, 9 aa, Borrelia DbpA
SGIYDLIYR

SEQ ID NO: 3630 - protein, 9 aa, Borrelia DbpA
IIAIVKVMK

SEQ ID NO: 3631 - protein, 9 aa, Borrelia DbpA
KYIKKNLLK

SEQ ID NO: 3632 - protein, 9 aa, Borrelia DbpA
GATKIRLER

SEQ ID NO: 3633 - protein, 9 aa, Borrelia DbpA
KIRLERSAK

SEQ ID NO: 3634 - protein, 9 aa, Borrelia DbpA
KGVNFDAFK

SEQ ID NO: 3635 - protein, 9 aa, Borrelia DbpA
AMYDLMFEV

SEQ ID NO: 3636 - protein, 9 aa, Borrelia DbpA
HTKNYCTLK

SEQ ID NO: 3637 - protein, 9 aa, Borrelia DbpA
KNYCTLKKK

SEQ ID NO: 3638 - protein, 9 aa, Borrelia DbpA
IALTLQFLK

SEQ ID NO: 3639 - protein, 9 aa, Borrelia DbpA
KIKLESSAK

SEQ ID NO: 3640 - protein, 9 aa, Borrelia DbpA
SATGGKVAR

SEQ ID NO: 3641 - protein, 9 aa, Borrelia DbpA
VARSGSESR

SEQ ID NO: 3642 - protein, 9 aa, Borrelia DbpA
AGNFIKQAK

SEQ ID NO: 3643 - protein, 9 aa, Borrelia DbpA
AMYDLMFEV

SEQ ID NO: 3644 - protein, 9 aa, Borrelia DbpA
KMREKLIRV

SEQ ID NO: 3645 - protein, 10 aa, Borrelia DbpA
MTKTVEEAAK

SEQ ID NO: 3646 - protein, 10 aa, Borrelia DbpA
VMKAKVENIK

SEQ ID NO: 3647 - protein, 10 aa, Borrelia DbpA
GSQIRAAKIR

SEQ ID NO: 3648 - protein, 10 aa, Borrelia DbpA
MTKHTKNLIK

SEQ ID NO: 3649 - protein, 10 aa, Borrelia DbpA
VSKKPEFILK

SEQ ID NO: 3650 - protein, 10 aa, Borrelia DbpA
KIQAIQVAGK

SEQ ID NO: 3651 - protein, 10 aa, Borrelia DbpA
MTKYIKNLLK

SEQ ID NO: 3652 - protein, 10 aa, Borrelia DbpA
KIRVINLSVK

SEQ ID NO: 3653 - protein, 10 aa, Borrelia DbpA
VINLSVKFLK

SEQ ID NO: 3654 - protein, 10 aa, Borrelia DbpA
KIKGKQETNK

SEQ ID NO: 3655 - protein, 10 aa, Borrelia DbpA
KANAKKEGVK

SEQ ID NO: 3656 - protein, 10 aa, Borrelia DbpA
KIQAIQVAEK

SEQ ID NO: 3657 - protein, 10 aa, Borrelia DbpA
KQHEALKNLK

SEQ ID NO: 3658 - protein, 10 aa, Borrelia DbpA
FSGIYDLIYR

SEQ ID NO: 3659 - protein, 10 aa, Borrelia DbpA
VMKAKVENIK

SEQ ID NO: 3660 - protein, 10 aa, Borrelia DbpA
KANAKKEGVK

SEQ ID NO: 3661 - protein, 10 aa, Borrelia DbpA
KIKAIQVAEK

SEQ ID NO: 3662 - protein, 10 aa, Borrelia DbpA
KVRATTVAEK

SEQ ID NO: 3663 - protein, 10 aa, Borrelia DbpA
GVLEIAKKMR

SEQ ID NO: 3664 - protein, 10 aa, Borrelia DbpA
VHTKNYCTLK

SEQ ID NO: 3665 - protein, 10 aa, Borrelia DbpA
HTKNYCTLKK

SEQ ID NO: 3666 - protein, 10 aa, Borrelia DbpA
KTGAKMGGPK

SEQ ID NO: 3667 - protein, 10 aa, Borrelia DbpA
IIALTLQFLK

SEQ ID NO: 3668 - protein, 10 aa, Borrelia DbpA
KVARSGSESR

SEQ ID NO: 3669 - protein, 10 aa, Borrelia DbpA
RAGNFIKQAK

SEQ ID NO: 3670 - protein, 10 aa, Borrelia DbpA
KVRAIDTAEK

SEQ ID NO: 3671 - protein, 10 aa, Borrelia DbpA
MTKEVSDAAK

SEQ ID NO: 3672 - protein, 10 aa, Borrelia DbpA
GVLEIAKKMR

SEQ ID NO: 3673 - protein, 10 aa, Borrelia DbpA
KMREKLIRVK

SEQ ID NO: 3674 - protein, 11 aa, Borrelia DbpA
RVINLSVKFLK

SEQ ID NO: 3675 - protein, 11 aa, Borrelia DbpA
AMYDLMFEVSK

SEQ ID NO: 3676 - protein, 11 aa, Borrelia DbpA
RVHTKNYCTLK

SEQ ID NO: 3677 - protein, 11 aa, Borrelia DbpA
RIIALTLQFLK

SEQ ID NO: 3678 - protein, 11 aa, Borrelia DbpA
AMYDLMFEVSK

SEQ ID NO: 3679 - protein, 12 aa, Borrelia DbpA
SKVSKKPEFILK

SEQ ID NO: 3680 - protein, 12 aa, Borrelia DbpA
KTGAKKGGPQIR

SEQ ID NO: 3681 - protein, 12 aa, Borrelia DbpA
IRVINLSVKFLK

SEQ ID NO: 3682 - protein, 12 aa, Borrelia DbpA
SAMYDLMFEVSK

SEQ ID NO: 3683 - protein, 12 aa, Borrelia DbpA
KMREKLQRVHTK

SEQ ID NO: 3684 - protein, 12 aa, Borrelia DbpA
QRVHTKNYCTLK

SEQ ID NO: 3685 - protein, 12 aa, Borrelia DbpA
RVHTKNYCTLKK

SEQ ID NO: 3686 - protein, 12 aa, Borrelia DbpA
KTGAKMGGPKTR

SEQ ID NO: 3687 - protein, 12 aa, Borrelia DbpA
LRIIALTLQFLK

SEQ ID NO: 3688 - protein, 12 aa, Borrelia DbpA
RAGNFIKQAKVR

SEQ ID NO: 3689 - protein, 12 aa, Borrelia DbpA
SAMYDLMFEVSK

SEQ ID NO: 3690 - protein, 12 aa, Borrelia DbpA
KMREKLIRVKGK

SEQ ID NO: 3691 - protein, 9 aa, Borrelia DbpA
KYNKIILTL

SEQ ID NO: 3692 - protein, 9 aa, Borrelia DbpA
LTLTLLASL

SEQ ID NO: 3693 - protein, 9 aa, Borrelia DbpA
ITNEIEKAI

SEQ ID NO: 3694 - protein, 9 aa, Borrelia DbpA
KIRVADLTI

SEQ ID NO: 3695 - protein, 9 aa, Borrelia DbpA
RVADLTIKF

SEQ ID NO: 3696 - protein, 9 aa, Borrelia DbpA
ATEEETITF

SEQ ID NO: 3697 - protein, 9 aa, Borrelia DbpA
TTADGIIAI

SEQ ID NO: 3698 - protein, 9 aa, Borrelia DbpA
KIQAIQVAG

SEQ ID NO: 3699 - protein, 9 aa, Borrelia DbpA
LMLDVSKPL

SEQ ID NO: 3700 - protein, 9 aa, Borrelia DbpA
TTAEGILAI

SEQ ID NO: 3701 - protein, 9 aa, Borrelia DbpA
KIRVINLSV

SEQ ID NO: 3702 - protein, 9 aa, Borrelia DbpA
RVINLSVKF

SEQ ID NO: 3703 - protein, 9 aa, Borrelia DbpA
GILMIANTI

SEQ ID NO: 3704 - protein, 9 aa, Borrelia DbpA
LMLDVSKPL

SEQ ID NO: 3705 - protein, 9 aa, Borrelia DbpA
KMTGTVTQV

SEQ ID NO: 3706 - protein, 9 aa, Borrelia DbpA
TTAEGILAI

SEQ ID NO: 3707 - protein, 9 aa, Borrelia DbpA
KYNKIILTL

SEQ ID NO: 3708 - protein, 9 aa, Borrelia DbpA
LTLTLLASL

SEQ ID NO: 3709 - protein, 9 aa, Borrelia DbpA
ITNEIDKAI

SEQ ID NO: 3710 - protein, 9 aa, Borrelia DbpA
KKLVADLTI

SEQ ID NO: 3711 - protein, 9 aa, Borrelia DbpA
LVADLTIEF

SEQ ID NO: 3712 - protein, 9 aa, Borrelia DbpA
ATEEETITF

SEQ ID NO: 3713 - protein, 9 aa, Borrelia DbpA
RTAEAVEKI

SEQ ID NO: 3714 - protein, 9 aa, Borrelia DbpA
TTANGIIAI

SEQ ID NO: 3715 - protein, 9 aa, Borrelia DbpA
KAIQVAEKF

SEQ ID NO: 3716 - protein, 9 aa, Borrelia DbpA
LMLDVSKPL

SEQ ID NO: 3717 - protein, 9 aa, Borrelia DbpA
TTAEGILAI

SEQ ID NO: 3718 - protein, 9 aa, Borrelia DbpA
KTFNNLLKL

SEQ ID NO: 3719 - protein, 9 aa, Borrelia DbpA
AMYDLMFEV

SEQ ID NO: 3720 - protein, 9 aa, Borrelia DbpA
LMFEVSKPL

SEQ ID NO: 3721 - protein, 9 aa, Borrelia DbpA
TTAQGVLEI

SEQ ID NO: 3722 - protein, 9 aa, Borrelia DbpA
ITNEIDKAI

SEQ ID NO: 3723 - protein, 9 aa, Borrelia DbpA
KLRIIALTL

SEQ ID NO: 3724 - protein, 9 aa, Borrelia DbpA
RIIALTLQF

SEQ ID NO: 3725 - protein, 9 aa, Borrelia DbpA
LMLKISKAV

SEQ ID NO: 3726 - protein, 9 aa, Borrelia DbpA
KISKAVEGI

SEQ ID NO: 3727 - protein, 9 aa, Borrelia DbpA
GIQNMTATV

SEQ ID NO: 3728 - protein, 9 aa, Borrelia DbpA
MTATVSMGI

SEQ ID NO: 3729 - protein, 9 aa, Borrelia DbpA
KTFNNLLKL

SEQ ID NO: 3730 - protein, 9 aa, Borrelia DbpA
AMYDLMFEV

SEQ ID NO: 3731 - protein, 9 aa, Borrelia DbpA
LMFEVSKPL

SEQ ID NO: 3732 - protein, 9 aa, Borrelia DbpA
TTAQGVLEI

SEQ ID NO: 3733 - protein, 10 aa, Borrelia DbpA
IRVINLSVKF

SEQ ID NO: 3734 - protein, 10 aa, Borrelia DbpA
RVINLSVKFL

SEQ ID NO: 3735 - protein, 10 aa, Borrelia DbpA
KLVADLTIEF

SEQ ID NO: 3736 - protein, 10 aa, Borrelia DbpA
KTTANGIIAI

SEQ ID NO: 3737 - protein, 10 aa, Borrelia DbpA
LRIIALTLQF

SEQ ID NO: 3738 - protein, 10 aa, Borrelia DbpA
RIIALTLQFL

SEQ ID NO: 3739 - protein, 10 aa, Borrelia DbpA
ASMGVNFDAF

SEQ ID NO: 3740 - protein, 11 aa, Borrelia DbpA
KTFNNLLKLTI

SEQ ID NO: 3741 - protein, 12 aa, Borrelia DbpA
NKTFNNLLKLTI

SEQ ID NO: 3742 - protein, 12 aa, Borrelia DbpA
KTFNNLLKLTIL

SEQ ID NO: 3743 - protein, 9 aa, Borrelia DbpA
LAACSLTGK

SEQ ID NO: 3744 - protein, 9 aa, Borrelia DbpA
FTETQTGGK

SEQ ID NO: 3745 - protein, 9 aa, Borrelia DbpA
LNAAKAVEK

SEQ ID NO: 3746 - protein, 9 aa, Borrelia DbpA
IIEIVKVMK

SEQ ID NO: 3747 - protein, 9 aa, Borrelia DbpA
EIVKVMKAK

SEQ ID NO: 3748 - protein, 9 aa, Borrelia DbpA
IIAIVKVMK

SEQ ID NO: 3749 - protein, 9 aa, Borrelia DbpA
QTGSKVSKK

SEQ ID NO: 3750 - protein, 9 aa, Borrelia DbpA
GTVTQAAEK

SEQ ID NO: 3751 - protein, 9 aa, Borrelia DbpA
NTKQHEALK

SEQ ID NO: 3752 - protein, 9 aa, Borrelia DbpA
EALKNLEGK

SEQ ID NO: 3753 - protein, 9 aa, Borrelia DbpA
LVACSLTGK

SEQ ID NO: 3754 - protein, 9 aa, Borrelia DbpA
INLSVKFLK

SEQ ID NO: 3755 - protein, 9 aa, Borrelia DbpA
KTVTQAAEK

SEQ ID NO: 3756 - protein, 9 aa, Borrelia DbpA
MIANTIEDK

SEQ ID NO: 3757 - protein, 9 aa, Borrelia DbpA
NTIEDKLKK

SEQ ID NO: 3758 - protein, 9 aa, Borrelia DbpA
QTGSKVSEK

SEQ ID NO: 3759 - protein, 9 aa, Borrelia DbpA
GTVTQVAEK

SEQ ID NO: 3760 - protein, 9 aa, Borrelia DbpA
EALKNLKEK

SEQ ID NO: 3761 - protein, 9 aa, Borrelia DbpA
LAACSLTGK

SEQ ID NO: 3762 - protein, 9 aa, Borrelia DbpA
FTETQTGGK

SEQ ID NO: 3763 - protein, 9 aa, Borrelia DbpA
SGIYDLIYR

SEQ ID NO: 3764 - protein, 9 aa, Borrelia DbpA
EAVEKIGMK

SEQ ID NO: 3765 - protein, 9 aa, Borrelia DbpA
IIAIVKVMK

SEQ ID NO: 3766 - protein, 9 aa, Borrelia DbpA
QTGSKVSEK

SEQ ID NO: 3767 - protein, 9 aa, Borrelia DbpA
GTVTKEAEK

SEQ ID NO: 3768 - protein, 9 aa, Borrelia DbpA
AIAQAMEEK

SEQ ID NO: 3769 - protein, 9 aa, Borrelia DbpA
DALKNLEEK

SEQ ID NO: 3770 - protein, 9 aa, Borrelia DbpA
GATKIRLER

SEQ ID NO: 3771 - protein, 9 aa, Borrelia DbpA
ITDEIDAIK

SEQ ID NO: 3772 - protein, 9 aa, Borrelia DbpA
ENPFILEAK

SEQ ID NO: 3773 - protein, 9 aa, Borrelia DbpA
IAIEEEATK

SEQ ID NO: 3774 - protein, 9 aa, Borrelia DbpA
YDLMFEVSK

SEQ ID NO: 3775 - protein, 9 aa, Borrelia DbpA
EIAKKMREK

SEQ ID NO: 3776 - protein, 9 aa, Borrelia DbpA
HTKNYCTLK

SEQ ID NO: 3777 - protein, 9 aa, Borrelia DbpA
ENSTFTDEK

SEQ ID NO: 3778 - protein, 9 aa, Borrelia DbpA
STFTDEKCK

SEQ ID NO: 3779 - protein, 9 aa, Borrelia DbpA
DTNAFTDQK

SEQ ID NO: 3780 - protein, 9 aa, Borrelia DbpA
IALTLQFLK

SEQ ID NO: 3781 - protein, 9 aa, Borrelia DbpA
TLQFLKETK

SEQ ID NO: 3782 - protein, 9 aa, Borrelia DbpA
YGAGEDEFK

SEQ ID NO: 3783 - protein, 9 aa, Borrelia DbpA
MTATVSMGI

SEQ ID NO: 3784 - protein, 9 aa, Borrelia DbpA
IVDEIDAIK

SEQ ID NO: 3785 - protein, 9 aa, Borrelia DbpA
FTDSATGGK

SEQ ID NO: 3786 - protein, 9 aa, Borrelia DbpA
SATGGKVAR

SEQ ID NO: 3787 - protein, 9 aa, Borrelia DbpA
VARSGSESR

SEQ ID NO: 3788 - protein, 9 aa, Borrelia DbpA
ESRAGNFIK

SEQ ID NO: 3789 - protein, 9 aa, Borrelia DbpA
TAIEEEATK

SEQ ID NO: 3790 - protein, 9 aa, Borrelia DbpA
YDLMFEVSK

SEQ ID NO: 3791 - protein, 9 aa, Borrelia DbpA
EIAKKMREK

SEQ ID NO: 3792 - protein, 10 aa, Borrelia DbpA
LLAACSLTGK

SEQ ID NO: 3793 - protein, 10 aa, Borrelia DbpA
ITNEIEKAIK

SEQ ID NO: 3794 - protein, 10 aa, Borrelia DbpA
MTKTVEEAAK

SEQ ID NO: 3795 - protein, 10 aa, Borrelia DbpA
TANGIIEIVK

SEQ ID NO: 3796 - protein, 10 aa, Borrelia DbpA
GIIEIVKVMK

SEQ ID NO: 3797 - protein, 10 aa, Borrelia DbpA
QAVEEAAKEK

SEQ ID NO: 3798 - protein, 10 aa, Borrelia DbpA
TADGIIAIVK

SEQ ID NO: 3799 - protein, 10 aa, Borrelia DbpA
GIIAIVKVMK

SEQ ID NO: 3800 - protein, 10 aa, Borrelia DbpA
IAIVKVMKAK

SEQ ID NO: 3801 - protein, 10 aa, Borrelia DbpA
MTKHTKNLIK

SEQ ID NO: 3802 - protein, 10 aa, Borrelia DbpA
EIKDEINKIK

SEQ ID NO: 3803 - protein, 10 aa, Borrelia DbpA
EINKIKANAK

SEQ ID NO: 3804 - protein, 10 aa, Borrelia DbpA
GVNFEAFTDK

SEQ ID NO: 3805 - protein, 10 aa, Borrelia DbpA
TGTVTQAAEK

SEQ ID NO: 3806 - protein, 10 aa, Borrelia DbpA
TAEGILAIAK

SEQ ID NO: 3807 - protein, 10 aa, Borrelia DbpA
LAIAKAMEDK

SEQ ID NO: 3808 - protein, 10 aa, Borrelia DbpA
MTKYIKNLLK

SEQ ID NO: 3809 - protein, 10 aa, Borrelia DbpA
LLVACSLTGK

SEQ ID NO: 3810 - protein, 10 aa, Borrelia DbpA
ITDEIDKAIK

SEQ ID NO: 3811 - protein, 10 aa, Borrelia DbpA
VINLSVKFLK

SEQ ID NO: 3812 - protein, 10 aa, Borrelia DbpA
EIEEEANILK

SEQ ID NO: 3813 - protein, 10 aa, Borrelia DbpA
MLNAAGSLQK

SEQ ID NO: 3814 - protein, 10 aa, Borrelia DbpA
IKTVTQAAEK

SEQ ID NO: 3815 - protein, 10 aa, Borrelia DbpA
LMIANTIEDK

SEQ ID NO: 3816 - protein, 10 aa, Borrelia DbpA
IANTIEDKLK

SEQ ID NO: 3817 - protein, 10 aa, Borrelia DbpA
EIKDEINKIK

SEQ ID NO: 3818 - protein, 10 aa, Borrelia DbpA
EINKIKANAK

SEQ ID NO: 3819 - protein, 10 aa, Borrelia DbpA
TGTVTQVAEK

SEQ ID NO: 3820 - protein, 10 aa, Borrelia DbpA
LAIAQAMEDK

SEQ ID NO: 3821 - protein, 10 aa, Borrelia DbpA
IAQAMEDKLK

SEQ ID NO: 3822 - protein, 10 aa, Borrelia DbpA
LLAACSLTGK

SEQ ID NO: 3823 - protein, 10 aa, Borrelia DbpA
ITNEIDKAIK

SEQ ID NO: 3824 - protein, 10 aa, Borrelia DbpA
EIDKAIKAAK

SEQ ID NO: 3825 - protein, 10 aa, Borrelia DbpA
VADLTIEFLK

SEQ ID NO: 3826 - protein, 10 aa, Borrelia DbpA
FSGIYDLIYR

SEQ ID NO: 3827 - protein, 10 aa, Borrelia DbpA
TANGIIAIVK

SEQ ID NO: 3828 - protein, 10 aa, Borrelia DbpA
GIIAIVKVMK

SEQ ID NO: 3829 - protein, 10 aa, Borrelia DbpA
IAIVKVMKAK

SEQ ID NO: 3830 - protein, 10 aa, Borrelia DbpA
EIKDEINKIK

SEQ ID NO: 3831 - protein, 10 aa, Borrelia DbpA
EINKIKANAK

SEQ ID NO: 3832 - protein, 10 aa, Borrelia DbpA
TGTVTKEAEK

SEQ ID NO: 3833 - protein, 10 aa, Borrelia DbpA
LAIAQAMEEK

SEQ ID NO: 3834 - protein, 10 aa, Borrelia DbpA
NNKTFNNLLK

SEQ ID NO: 3835 - protein, 10 aa, Borrelia DbpA
ISCGLTGATK

SEQ ID NO: 3836 - protein, 10 aa, Borrelia DbpA
TGATKIRLER

SEQ ID NO: 3837 - protein, 10 aa, Borrelia DbpA
DITDEIDAIK

SEQ ID NO: 3838 - protein, 10 aa, Borrelia DbpA
ITDEIDAIKK

SEQ ID NO: 3839 - protein, 10 aa, Borrelia DbpA
DAIKKDAALK

SEQ ID NO: 3840 - protein, 10 aa, Borrelia DbpA
LKGVNFDAFK

SEQ ID NO: 3841 - protein, 10 aa, Borrelia DbpA
NPFILEAKVR

SEQ ID NO: 3842 - protein, 10 aa, Borrelia DbpA
KVRATTVAEK

SEQ ID NO: 3843 - protein, 10 aa, Borrelia DbpA
TAQGVLEIAK

SEQ ID NO: 3844 - protein, 10 aa, Borrelia DbpA
VHTKNYCTLK

SEQ ID NO: 3845 - protein, 10 aa, Borrelia DbpA
HTKNYCTLKK

SEQ ID NO: 3846 - protein, 10 aa, Borrelia DbpA
KENSTFTDEK

SEQ ID NO: 3847 - protein, 10 aa, Borrelia DbpA
NSTFTDEKCK

SEQ ID NO: 3848 - protein, 10 aa, Borrelia DbpA
ITNEIDKAIK

SEQ ID NO: 3849 - protein, 10 aa, Borrelia DbpA
VDTNAFTDQK

SEQ ID NO: 3850 - protein, 10 aa, Borrelia DbpA
IIALTLQFLK

SEQ ID NO: 3851 - protein, 10 aa, Borrelia DbpA
LTLQFLKETK

SEQ ID NO: 3852 - protein, 10 aa, Borrelia DbpA
ETKEEAIKLK

SEQ ID NO: 3853 - protein, 10 aa, Borrelia DbpA
EYGAGEDEFK

SEQ ID NO: 3854 - protein, 10 aa, Borrelia DbpA
NNKTFNNLLK

SEQ ID NO: 3855 - protein, 10 aa, Borrelia DbpA
ISCGLTGATK

SEQ ID NO: 3856 - protein, 10 aa, Borrelia DbpA
AIVDEIDAIK

SEQ ID NO: 3857 - protein, 10 aa, Borrelia DbpA
DSATGGKVAR

SEQ ID NO: 3858 - protein, 10 aa, Borrelia DbpA
KVARSGSESR

SEQ ID NO: 3859 - protein, 10 aa, Borrelia DbpA
LTAIEEEATK

SEQ ID NO: 3860 - protein, 10 aa, Borrelia DbpA
MTKEVSDAAK

SEQ ID NO: 3861 - protein, 10 aa, Borrelia DbpA
TAQGVLEIAK

SEQ ID NO: 3862 - protein, 11 aa, Borrelia DbpA
EATEEETITFK

SEQ ID NO: 3863 - protein, 11 aa, Borrelia DbpA
TTANGIIEIVK

SEQ ID NO: 3864 - protein, 11 aa, Borrelia DbpA
TTADGIIAIVK

SEQ ID NO: 3865 - protein, 11 aa, Borrelia DbpA
FVKAIKEEAEK

SEQ ID NO: 3866 - protein, 11 aa, Borrelia DbpA
MTGTVTQAAEK

SEQ ID NO: 3867 - protein, 11 aa, Borrelia DbpA
TTAEGILAIAK

SEQ ID NO: 3868 - protein, 11 aa, Borrelia DbpA
MIKTVTQAAEK

SEQ ID NO: 3869 - protein, 11 aa, Borrelia DbpA
MIANTIEDKLK

SEQ ID NO: 3870 - protein, 11 aa, Borrelia DbpA
MTKYIKKNLLK

SEQ ID NO: 3871 - protein, 11 aa, Borrelia DbpA
FVKAIKEEAEK

SEQ ID NO: 3872 - protein, 11 aa, Borrelia DbpA
MTGTVTQVAEK

SEQ ID NO: 3873 - protein, 11 aa, Borrelia DbpA
LVADLTIEFLK

SEQ ID NO: 3874 - protein, 11 aa, Borrelia DbpA
EFSGIYDLIYR

SEQ ID NO: 3875 - protein, 11 aa, Borrelia DbpA
TTANGIIAIVK

SEQ ID NO: 3876 - protein, 11 aa, Borrelia DbpA
MTKYIKKNLLK

SEQ ID NO: 3877 - protein, 11 aa, Borrelia DbpA
FVKAIKEEAEK

SEQ ID NO: 3878 - protein, 11 aa, Borrelia DbpA
MTGTVTKEAEK

SEQ ID NO: 3879 - protein, 11 aa, Borrelia DbpA
FVIAIEEEATK

SEQ ID NO: 3880 - protein, 12 aa, Borrelia DbpA
LEATEEETITFK

SEQ ID NO: 3881 - protein, 12 aa, Borrelia DbpA
KTTANGIIEIVK

SEQ ID NO: 3882 - protein, 12 aa, Borrelia DbpA
KTTADGIIAIVK

SEQ ID NO: 3883 - protein, 12 aa, Borrelia DbpA
SAMYDLMLDVSK

SEQ ID NO: 3884 - protein, 12 aa, Borrelia DbpA
KMTGTVTQAAEK

SEQ ID NO: 3885 - protein, 12 aa, Borrelia DbpA
EMIKTVTQAAEK

SEQ ID NO: 3886 - protein, 12 aa, Borrelia DbpA
LMIANTIEDKLK

SEQ ID NO: 3887 - protein, 12 aa, Borrelia DbpA
MIANTIEDKLKK

SEQ ID NO: 3888 - protein, 12 aa, Borrelia DbpA
SAMYDLMLDVSK

SEQ ID NO: 3889 - protein, 12 aa, Borrelia DbpA
KMTGTVTQVAEK

SEQ ID NO: 3890 - protein, 12 aa, Borrelia DbpA
KLVADLTIEFLK

SEQ ID NO: 3891 - protein, 12 aa, Borrelia DbpA
DEFSGIYDLIYR

SEQ ID NO: 3892 - protein, 12 aa, Borrelia DbpA
KTTANGIIAIVK

SEQ ID NO: 3893 - protein, 12 aa, Borrelia DbpA
SAMYDLMLDVSK

SEQ ID NO: 3894 - protein, 12 aa, Borrelia DbpA
KMTGTVTKEAEK

SEQ ID NO: 3895 - protein, 12 aa, Borrelia DbpA
AALKGVNFDAFK

SEQ ID NO: 3896 - protein, 12 aa, Borrelia DbpA
EAKVRATTVAEK

SEQ ID NO: 3897 - protein, 12 aa, Borrelia DbpA
KFVIAIEEEATK

SEQ ID NO: 3898 - protein, 12 aa, Borrelia DbpA
SAMYDLMFEVSK

SEQ ID NO: 3899 - protein, 12 aa, Borrelia DbpA
FTDSATGGKVAR

SEQ ID NO: 3900 - protein, 12 aa, Borrelia DbpA
SAMYDLMFEVSK

SEQ ID NO: 3901 - protein, 9 aa, Borrelia DbpA
GPKIRAAKI

SEQ ID NO: 3902 - protein, 9 aa, Borrelia DbpA
ILKAKIQAI

SEQ ID NO: 3903 - protein, 9 aa, Borrelia DbpA
FSAMYDLML

SEQ ID NO: 3904 - protein, 9 aa, Borrelia DbpA
KIRVINLSV

SEQ ID NO: 3905 - protein, 9 aa, Borrelia DbpA
PPTTAQGVL

SEQ ID NO: 3906 - protein, 9 aa, Borrelia DbpA
GPKTREAKL

SEQ ID NO: 3907 - protein, 9 aa, Borrelia DbpA
KLRIIALTL

SEQ ID NO: 3908 - protein, 9 aa, Borrelia DbpA
PPTTAQGVL

SEQ ID NO: 3909 - protein, 10 aa, Borrelia DbpA
RAAKIRVADL

SEQ ID NO: 3910 - protein, 10 aa, Borrelia DbpA
KPKTTADGII

SEQ ID NO: 3911 - protein, 10 aa, Borrelia DbpA
KPEFILKAKI

SEQ ID NO: 3912 - protein, 10 aa, Borrelia DbpA
KPEFILKAKI

SEQ ID NO: 3913 - protein, 10 aa, Borrelia DbpA
TPATTAEGIL

SEQ ID NO: 3914 - protein, 10 aa, Borrelia DbpA
KPEFILKAKI

SEQ ID NO: 3915 - protein, 10 aa, Borrelia DbpA
NPPTTAQGVL

SEQ ID NO: 3916 - protein, 10 aa, Borrelia DbpA
NPPTTAQGVL

SEQ ID NO: 3917 - protein, 11 aa, Borrelia DbpA
KPLQKLGIQEM

SEQ ID NO: 3918 - protein, 9 aa, Borrelia DbpA
MIKYNKIIL

SEQ ID NO: 3919 - protein, 9 aa, Borrelia DbpA
GPKIRAAKI

SEQ ID NO: 3920 - protein, 9 aa, Borrelia DbpA
AAKIRVADL

SEQ ID NO: 3921 - protein, 9 aa, Borrelia DbpA
FSGIYDLIL

SEQ ID NO: 3922 - protein, 9 aa, Borrelia DbpA
DAKIRVINL

SEQ ID NO: 3923 - protein, 9 aa, Borrelia DbpA
MIKTVTQAA

SEQ ID NO: 3924 - protein, 9 aa, Borrelia DbpA
MTKYIKKNL

SEQ ID NO: 3925 - protein, 9 aa, Borrelia DbpA
YIKKNLLKL

SEQ ID NO: 3926 - protein, 9 aa, Borrelia DbpA
ILKAKIQAI

SEQ ID NO: 3927 - protein, 9 aa, Borrelia DbpA
FSAMYDLML

SEQ ID NO: 3928 - protein, 9 aa, Borrelia DbpA
VNKKQHEAL

SEQ ID NO: 3929 - protein, 9 aa, Borrelia DbpA
NLKEKANTA

SEQ ID NO: 3930 - protein, 9 aa, Borrelia DbpA
MIKYNKIIL

SEQ ID NO: 3931 - protein, 9 aa, Borrelia DbpA
MTKYIKKNL

SEQ ID NO: 3932 - protein, 9 aa, Borrelia DbpA
YIKKNLLKL

SEQ ID NO: 3933 - protein, 9 aa, Borrelia DbpA
ILKAKIKAI

SEQ ID NO: 3934 - protein, 9 aa, Borrelia DbpA
FSAMYDLML

SEQ ID NO: 3935 - protein, 9 aa, Borrelia DbpA
MIKCNNKTF

SEQ ID NO: 3936 - protein, 9 aa, Borrelia DbpA
NNLLKLTIL

SEQ ID NO: 3937 - protein, 9 aa, Borrelia DbpA
DAIKKDAAL

SEQ ID NO: 3938 - protein, 9 aa, Borrelia DbpA
EAKVRATTV

SEQ ID NO: 3939 - protein, 9 aa, Borrelia DbpA
LMFEVSKPL

SEQ ID NO: 3940 - protein, 9 aa, Borrelia DbpA
KMREKLQRV

SEQ ID NO: 3941 - protein, 9 aa, Borrelia DbpA
TLKKKENST

SEQ ID NO: 3942 - protein, 9 aa, Borrelia DbpA
GPKTREAKL

SEQ ID NO: 3943 - protein, 9 aa, Borrelia DbpA
EAKLRIIAL

SEQ ID NO: 3944 - protein, 9 aa, Borrelia DbpA
KLRIIALTL

SEQ ID NO: 3945 - protein, 9 aa, Borrelia DbpA
ELMLKISKA

SEQ ID NO: 3946 - protein, 9 aa, Borrelia DbpA
LMLKISKAV

SEQ ID NO: 3947 - protein, 9 aa, Borrelia DbpA
MIKCNNKTF

SEQ ID NO: 3948 - protein, 9 aa, Borrelia DbpA
NNLLKLTIL

SEQ ID NO: 3949 - protein, 9 aa, Borrelia DbpA
LMFEVSKPL

SEQ ID NO: 3950 - protein, 10 aa, Borrelia DbpA
RAAKIRVADL

SEQ ID NO: 3951 - protein, 10 aa, Borrelia DbpA
FILKAKIQAI

SEQ ID NO: 3952 - protein, 10 aa, Borrelia DbpA
YIKNLLKLTL

SEQ ID NO: 3953 - protein, 10 aa, Borrelia DbpA
LLKDMYDLML

SEQ ID NO: 3954 - protein, 10 aa, Borrelia DbpA
MTKYIKKNLL

SEQ ID NO: 3955 - protein, 10 aa, Borrelia DbpA
KYIKKNLLKL

SEQ ID NO: 3956 - protein, 10 aa, Borrelia DbpA
LLKLSLIVSL

SEQ ID NO: 3957 - protein, 10 aa, Borrelia DbpA
FILKAKIQAI

SEQ ID NO: 3958 - protein, 10 aa, Borrelia DbpA
NVNKKQHEAL

SEQ ID NO: 3959 - protein, 10 aa, Borrelia DbpA
KNLKEKANTA

SEQ ID NO: 3960 - protein, 10 aa, Borrelia DbpA
NLKEKANTAA

SEQ ID NO: 3961 - protein, 10 aa, Borrelia DbpA
MTKYIKKNLL

SEQ ID NO: 3962 - protein, 10 aa, Borrelia DbpA
KYIKKNLLKL

SEQ ID NO: 3963 - protein, 10 aa, Borrelia DbpA
LLKLSLIVSL

SEQ ID NO: 3964 - protein, 10 aa, Borrelia DbpA
FILKAKIKAI

SEQ ID NO: 3965 - protein, 10 aa, Borrelia DbpA
FNNLLKLTIL

SEQ ID NO: 3966 - protein, 10 aa, Borrelia DbpA
IDAIKKDAAL

SEQ ID NO: 3967 - protein, 10 aa, Borrelia DbpA
LEAKVRATTV

SEQ ID NO: 3968 - protein, 10 aa, Borrelia DbpA
RVHTKNYCTL

SEQ ID NO: 3969 - protein, 10 aa, Borrelia DbpA
TLKKKENSTF

SEQ ID NO: 3970 - protein, 10 aa, Borrelia DbpA
REAKLRIIAL

SEQ ID NO: 3971 - protein, 10 aa, Borrelia DbpA
EAKLRIIALT

SEQ ID NO: 3972 - protein, 10 aa, Borrelia DbpA
FLKETKEEAI

SEQ ID NO: 3973 - protein, 10 aa, Borrelia DbpA
YELMLKISKA

SEQ ID NO: 3974 - protein, 10 aa, Borrelia DbpA
ELMLKISKAV

SEQ ID NO: 3975 - protein, 10 aa, Borrelia DbpA
FNNLLKLTIL

SEQ ID NO: 3976 - protein, 10 aa, Borrelia DbpA
FIKQAKVRAI

SEQ ID NO: 3977 - protein, 10 aa, Borrelia DbpA
LIRVKGKQKL

SEQ ID NO: 3978 - protein, 11 aa, Borrelia DbpA
EFILKAKIQAI

SEQ ID NO: 3979 - protein, 11 aa, Borrelia DbpA
QLLKDMYDLML

SEQ ID NO: 3980 - protein, 11 aa, Borrelia DbpA
YIKKNLLKLSL

SEQ ID NO: 3981 - protein, 11 aa, Borrelia DbpA
EFILKAKIQAI

SEQ ID NO: 3982 - protein, 11 aa, Borrelia DbpA
YIKKNLLKLSL

SEQ ID NO: 3983 - protein, 11 aa, Borrelia DbpA
EFILKAKIKAI

SEQ ID NO: 3984 - protein, 11 aa, Borrelia DbpA
MGGPKTREAKL

SEQ ID NO: 3985 - protein, 11 aa, Borrelia DbpA
TREAKLRIIAL

SEQ ID NO: 3986 - protein, 11 aa, Borrelia DbpA
NFIKQAKVRAI

SEQ ID NO: 3987 - protein, 12 aa, Borrelia DbpA
PEFILKAKIQAI

SEQ ID NO: 3988 - protein, 12 aa, Borrelia DbpA
DQLLKDMYDLML

SEQ ID NO: 3989 - protein, 12 aa, Borrelia DbpA
KYIKKNLLKLSL

SEQ ID NO: 3990 - protein, 12 aa, Borrelia DbpA
NAKKEGVKFEAF

SEQ ID NO: 3991 - protein, 12 aa, Borrelia DbpA
PEFILKAKIQAI

SEQ ID NO: 3992 - protein, 12 aa, Borrelia DbpA
KYIKKNLLKLSL

SEQ ID NO: 3993 - protein, 12 aa, Borrelia DbpA
NAKKEGVKFEAF

SEQ ID NO: 3994 - protein, 12 aa, Borrelia DbpA
PEFILKAKIKAI

SEQ ID NO: 3995 - protein, 12 aa, Borrelia DbpA
EFILKAKIKAIQ

SEQ ID NO: 3996 - protein, 12 aa, Borrelia DbpA
KMGGPKTREAKL

SEQ ID NO: 3997 - protein, 12 aa, Borrelia DbpA
KTREAKLRIIAL

SEQ ID NO: 3998 - protein, 12 aa, Borrelia DbpA
REAKLRIIALTL

SEQ ID NO: 3999 - protein, 12 aa, Borrelia DbpA
LYELMLKISKAV

SEQ ID NO: 4000 - protein, 12 aa, Borrelia DbpA
GNFIKQAKVRAI

SEQ ID NO: 4001 - protein, 9 aa, Borrelia DbpA
IKYNKIILT

SEQ ID NO: 4002 - protein, 9 aa, Borrelia DbpA
NKIILTLTL

SEQ ID NO: 4003 - protein, 9 aa, Borrelia DbpA
LTLTLLASL

SEQ ID NO: 4004 - protein, 9 aa, Borrelia DbpA
ASLLAACSL

SEQ ID NO: 4005 - protein, 9 aa, Borrelia DbpA
RVADLTIKF

SEQ ID NO: 4006 - protein, 9 aa, Borrelia DbpA
ATEEETITF

SEQ ID NO: 4007 - protein, 9 aa, Borrelia DbpA
VMKAKVENI

SEQ ID NO: 4008 - protein, 9 aa, Borrelia DbpA
IKLSLIVSL

SEQ ID NO: 4009 - protein, 9 aa, Borrelia DbpA
KLESSAQEI

SEQ ID NO: 4010 - protein, 9 aa, Borrelia DbpA
NAKKEGVNF

SEQ ID NO: 4011 - protein, 9 aa, Borrelia DbpA
KEGVNFEAF

SEQ ID NO: 4012 - protein, 9 aa, Borrelia DbpA
SKVSKKPEF

SEQ ID NO: 4013 - protein, 9 aa, Borrelia DbpA
KKPEFILKA

SEQ ID NO: 4014 - protein, 9 aa, Borrelia DbpA
ILKAKIQAI

SEQ ID NO: 4015 - protein, 9 aa, Borrelia DbpA
AKIQAIQVA

SEQ ID NO: 4016 - protein, 9 aa, Borrelia DbpA
KLKKSGSSG

SEQ ID NO: 4017 - protein, 9 aa, Borrelia DbpA
LKKSGSSGA

SEQ ID NO: 4018 - protein, 9 aa, Borrelia DbpA
KKSGSSGAF

SEQ ID NO: 4019 - protein, 9 aa, Borrelia DbpA
SSGAFSAMY

SEQ ID NO: 4020 - protein, 9 aa, Borrelia DbpA
FSAMYDLML

SEQ ID NO: 4021 - protein, 9 aa, Borrelia DbpA
AMYDLMLDV

SEQ ID NO: 4022 - protein, 9 aa, Borrelia DbpA
LMLDVSKPL

SEQ ID NO: 4023 - protein, 9 aa, Borrelia DbpA
IQKMTGTVT

SEQ ID NO: 4024 - protein, 9 aa, Borrelia DbpA
KMTGTVTQA

SEQ ID NO: 4025 - protein, 9 aa, Borrelia DbpA
KQHEALKNL

SEQ ID NO: 4026 - protein, 9 aa, Borrelia DbpA
IKNLLKLTL

SEQ ID NO: 4027 - protein, 9 aa, Borrelia DbpA
LKLTLIVGL

SEQ ID NO: 4028 - protein, 9 aa, Borrelia DbpA
RVINLSVKF

SEQ ID NO: 4029 - protein, 9 aa, Borrelia DbpA
LKDMYDLML

SEQ ID NO: 4030 - protein, 9 aa, Borrelia DbpA
LMLNAAGSL

SEQ ID NO: 4031 - protein, 9 aa, Borrelia DbpA
LQKLGLQEM

SEQ ID NO: 4032 - protein, 9 aa, Borrelia DbpA
KKNLLKLSL

SEQ ID NO: 4033 - protein, 9 aa, Borrelia DbpA
LKLSLIVSL

SEQ ID NO: 4034 - protein, 9 aa, Borrelia DbpA
RLESSAQEI

SEQ ID NO: 4035 - protein, 9 aa, Borrelia DbpA
NAKKEGVKF

SEQ ID NO: 4036 - protein, 9 aa, Borrelia DbpA
KEGVKFEAF

SEQ ID NO: 4037 - protein, 9 aa, Borrelia DbpA
SKVSEKPEF

SEQ ID NO: 4038 - protein, 9 aa, Borrelia DbpA
ILKAKIQAI

SEQ ID NO: 4039 - protein, 9 aa, Borrelia DbpA
AKIQAIQVA

SEQ ID NO: 4040 - protein, 9 aa, Borrelia DbpA
QAIQVAEKF

SEQ ID NO: 4041 - protein, 9 aa, Borrelia DbpA
KLKKSGSSG

SEQ ID NO: 4042 - protein, 9 aa, Borrelia DbpA
LKKSGSSGA

SEQ ID NO: 4043 - protein, 9 aa, Borrelia DbpA
KKSGSSGAF

SEQ ID NO: 4044 - protein, 9 aa, Borrelia DbpA
SSGAFSAMY

SEQ ID NO: 4045 - protein, 9 aa, Borrelia DbpA
FSAMYDLML

SEQ ID NO: 4046 - protein, 9 aa, Borrelia DbpA
AMYDLMLDV

SEQ ID NO: 4047 - protein, 9 aa, Borrelia DbpA
LMLDVSKPL

SEQ ID NO: 4048 - protein, 9 aa, Borrelia DbpA
IQKMTGTVT

SEQ ID NO: 4049 - protein, 9 aa, Borrelia DbpA
KMTGTVTQV

SEQ ID NO: 4050 - protein, 9 aa, Borrelia DbpA
TQVAEKTPA

SEQ ID NO: 4051 - protein, 9 aa, Borrelia DbpA
KKQHEALKN

SEQ ID NO: 4052 - protein, 9 aa, Borrelia DbpA
KQHEALKNL

SEQ ID NO: 4053 - protein, 9 aa, Borrelia DbpA
IKYNKIILT

SEQ ID NO: 4054 - protein, 9 aa, Borrelia DbpA
NKIILTLTL

SEQ ID NO: 4055 - protein, 9 aa, Borrelia DbpA
LTLTLLASL

SEQ ID NO: 4056 - protein, 9 aa, Borrelia DbpA
ASLLAACSL

SEQ ID NO: 4057 - protein, 9 aa, Borrelia DbpA
SQIRDAKKL

SEQ ID NO: 4058 - protein, 9 aa, Borrelia DbpA
KKLVADLTI

SEQ ID NO: 4059 - protein, 9 aa, Borrelia DbpA
LVADLTIEF

SEQ ID NO: 4060 - protein, 9 aa, Borrelia DbpA
LKATEEETI

SEQ ID NO: 4061 - protein, 9 aa, Borrelia DbpA
ATEEETITF

SEQ ID NO: 4062 - protein, 9 aa, Borrelia DbpA
FSGIYDLIY

SEQ ID NO: 4063 - protein, 9 aa, Borrelia DbpA
LIYRTAEAV

SEQ ID NO: 4064 - protein, 9 aa, Borrelia DbpA
VMKAKVENI

SEQ ID NO: 4065 - protein, 9 aa, Borrelia DbpA
KKNLLKLSL

SEQ ID NO: 4066 - protein, 9 aa, Borrelia DbpA
LKLSLIVSL

SEQ ID NO: 4067 - protein, 9 aa, Borrelia DbpA
RLESSAQEI

SEQ ID NO: 4068 - protein, 9 aa, Borrelia DbpA
NAKKEGVKF

SEQ ID NO: 4069 - protein, 9 aa, Borrelia DbpA
KEGVKFEAF

SEQ ID NO: 4070 - protein, 9 aa, Borrelia DbpA
SKVSEKPEF

SEQ ID NO: 4071 - protein, 9 aa, Borrelia DbpA
AKIKAIQVA

SEQ ID NO: 4072 - protein, 9 aa, Borrelia DbpA
KAIQVAEKF

SEQ ID NO: 4073 - protein, 9 aa, Borrelia DbpA
KLKKSGSSG

SEQ ID NO: 4074 - protein, 9 aa, Borrelia DbpA
LKKSGSSGA

SEQ ID NO: 4075 - protein, 9 aa, Borrelia DbpA
KKSGSSGAF

SEQ ID NO: 4076 - protein, 9 aa, Borrelia DbpA
SSGAFSAMY

SEQ ID NO: 4077 - protein, 9 aa, Borrelia DbpA
FSAMYDLML

SEQ ID NO: 4078 - protein, 9 aa, Borrelia DbpA
AMYDLMLDV

SEQ ID NO: 4079 - protein, 9 aa, Borrelia DbpA
LMLDVSKPL

SEQ ID NO: 4080 - protein, 9 aa, Borrelia DbpA
IQKMTGTVT

SEQ ID NO: 4081 - protein, 9 aa, Borrelia DbpA
KQQDALKNL

SEQ ID NO: 4082 - protein, 9 aa, Borrelia DbpA
MIKCNNKTF

SEQ ID NO: 4083 - protein, 9 aa, Borrelia DbpA
KTFNNLLKL

SEQ ID NO: 4084 - protein, 9 aa, Borrelia DbpA
LKLTILVNL

SEQ ID NO: 4085 - protein, 9 aa, Borrelia DbpA
LKGVNFDAF

SEQ ID NO: 4086 - protein, 9 aa, Borrelia DbpA
GSGVSENPF

SEQ ID NO: 4087 - protein, 9 aa, Borrelia DbpA
AKVRATTVA

SEQ ID NO: 4088 - protein, 9 aa, Borrelia DbpA
RATTVAEKF

SEQ ID NO: 4089 - protein, 9 aa, Borrelia DbpA
KETGSSGEF

SEQ ID NO: 4090 - protein, 9 aa, Borrelia DbpA
SSGEFSAMY

SEQ ID NO: 4091 - protein, 9 aa, Borrelia DbpA
FSAMYDLMF

SEQ ID NO: 4092 - protein, 9 aa, Borrelia DbpA
AMYDLMFEV

SEQ ID NO: 4093 - protein, 9 aa, Borrelia DbpA
LMFEVSKPL

SEQ ID NO: 4094 - protein, 9 aa, Borrelia DbpA
LQKLGIQEM

SEQ ID NO: 4095 - protein, 9 aa, Borrelia DbpA
KMREKLQRV

SEQ ID NO: 4096 - protein, 9 aa, Borrelia DbpA
LQRVHTKNY

SEQ ID NO: 4097 - protein, 9 aa, Borrelia DbpA
VHTKNYCTL

SEQ ID NO: 4098 - protein, 9 aa, Borrelia DbpA
LKKKENSTF

SEQ ID NO: 4099 - protein, 9 aa, Borrelia DbpA
KKKENSTFT

SEQ ID NO: 4100 - protein, 9 aa, Borrelia DbpA
KLRIIALTL

SEQ ID NO: 4101 - protein, 9 aa, Borrelia DbpA
RIIALTLQF

SEQ ID NO: 4102 - protein, 9 aa, Borrelia DbpA
FKELYELML

SEQ ID NO: 4103 - protein, 9 aa, Borrelia DbpA
LMLKISKAV

SEQ ID NO: 4104 - protein, 9 aa, Borrelia DbpA
IQNMTATVS

SEQ ID NO: 4105 - protein, 9 aa, Borrelia DbpA
QNMTATVSM

SEQ ID NO: 4106 - protein, 9 aa, Borrelia DbpA
MIKCNNKTF

SEQ ID NO: 4107 - protein, 9 aa, Borrelia DbpA
KTFNNLLKL

SEQ ID NO: 4108 - protein, 9 aa, Borrelia DbpA
LKLTILVNL

SEQ ID NO: 4109 - protein, 9 aa, Borrelia DbpA
IKLESSAKA

SEQ ID NO: 4110 - protein, 9 aa, Borrelia DbpA
KLESSAKAI

SEQ ID NO: 4111 - protein, 9 aa, Borrelia DbpA
AIKKEAASM

SEQ ID NO: 4112 - protein, 9 aa, Borrelia DbpA
EAASMGVNF

SEQ ID NO: 4113 - protein, 9 aa, Borrelia DbpA
SMGVNFDAF

SEQ ID NO: 4114 - protein, 9 aa, Borrelia DbpA
IKQAKVRAI

SEQ ID NO: 4115 - protein, 9 aa, Borrelia DbpA
RAIDTAEKF

SEQ ID NO: 4116 - protein, 9 aa, Borrelia DbpA
KETGSSGEF

SEQ ID NO: 4117 - protein, 9 aa, Borrelia DbpA
SSGEFSAMY

SEQ ID NO: 4118 - protein, 9 aa, Borrelia DbpA
FSAMYDLMF

SEQ ID NO: 4119 - protein, 9 aa, Borrelia DbpA
AMYDLMFEV

SEQ ID NO: 4120 - protein, 9 aa, Borrelia DbpA
LMFEVSKPL

SEQ ID NO: 4121 - protein, 9 aa, Borrelia DbpA
LQELGIQDM

SEQ ID NO: 4122 - protein, 9 aa, Borrelia DbpA
AKENPPTTA

SEQ ID NO: 4123 - protein, 9 aa, Borrelia DbpA
KMREKLIRV

SEQ ID NO: 4124 - protein, 9 aa, Borrelia DbpA
KQKLNPETN

SEQ ID NO: 4125 - protein, 10 aa, Borrelia DbpA
KKEGVNFEAF

SEQ ID NO: 4126 - protein, 10 aa, Borrelia DbpA
IQAIQVAGKF

SEQ ID NO: 4127 - protein, 10 aa, Borrelia DbpA
LKKSGSSGAF

SEQ ID NO: 4128 - protein, 10 aa, Borrelia DbpA
IQAIQVAEKF

SEQ ID NO: 4129 - protein, 10 aa, Borrelia DbpA
LKKSGSSGAF

SEQ ID NO: 4130 - protein, 10 aa, Borrelia DbpA
LKKSGSSGAF

SEQ ID NO: 4131 - protein, 10 aa, Borrelia DbpA
KLQRVHTKNY

SEQ ID NO: 4132 - protein, 10 aa, Borrelia DbpA
LQRVHTKNYC

SEQ ID NO: 4133 - protein, 10 aa, Borrelia DbpA
TLKKKENSTF

SEQ ID NO: 4134 - protein, 10 aa, Borrelia DbpA
LKKKENSTFT

SEQ ID NO: 4135 - protein, 10 aa, Borrelia DbpA
IQNMTATVSM

SEQ ID NO: 4136 - protein, 11 aa, Borrelia DbpA
KLKKSGSSGAF

SEQ ID NO: 4137 - protein, 11 aa, Borrelia DbpA
LKKSGSSGAFS

SEQ ID NO: 4138 - protein, 11 aa, Borrelia DbpA
KLKKSGSSGAF

SEQ ID NO: 4139 - protein, 11 aa, Borrelia DbpA
LKKSGSSGAFS

SEQ ID NO: 4140 - protein, 11 aa, Borrelia DbpA
KLKKSGSSGAF

SEQ ID NO: 4141 - protein, 11 aa, Borrelia DbpA
LKKSGSSGAFS

SEQ ID NO: 4142 - protein, 11 aa, Borrelia DbpA
KLKETGSSGEF

SEQ ID NO: 4143 - protein, 11 aa, Borrelia DbpA
CTLKKKENSTF

SEQ ID NO: 4144 - protein, 11 aa, Borrelia DbpA
KLKETGSSGEF

SEQ ID NO: 4145 - protein, 12 aa, Borrelia DbpA
EKLKKSGSSGAF

SEQ ID NO: 4146 - protein, 12 aa, Borrelia DbpA
KLKKSGSSGAFS

SEQ ID NO: 4147 - protein, 12 aa, Borrelia DbpA
EKLKKSGSSGAF

SEQ ID NO: 4148 - protein, 12 aa, Borrelia DbpA
KLKKSGSSGAFS

SEQ ID NO: 4149 - protein, 12 aa, Borrelia DbpA
EKLKKSGSSGAF

SEQ ID NO: 4150 - protein, 12 aa, Borrelia DbpA
KLKKSGSSGAFS

SEQ ID NO: 4151 - protein, 12 aa, Borrelia DbpA
KKTGSGVSENPF

SEQ ID NO: 4152 - protein, 12 aa, Borrelia DbpA
REKLQRVHTKNY

SEQ ID NO: 4153 - protein, 12 aa, Borrelia DbpA
YCTLKKKENSTF

SEQ ID NO: 4154 - protein, 9 aa, Borrelia DbpA
GEDEFSGIY

SEQ ID NO: 4155 - protein, 9 aa, Borrelia DbpA
DEFSGIYDL

SEQ ID NO: 4156 - protein, 9 aa, Borrelia DbpA
GEEDFSGIY

SEQ ID NO: 4157 - protein, 9 aa, Borrelia DbpA
GEDEFSGIY

SEQ ID NO: 4158 - protein, 9 aa, Borrelia DbpA
DEFSGIYDL

SEQ ID NO: 4159 - protein, 9 aa, Borrelia DbpA
SENPFILEA

SEQ ID NO: 4160 - protein, 9 aa, Borrelia DbpA
LEAKVRATT

SEQ ID NO: 4161 - protein, 9 aa, Borrelia DbpA
EEAIKLKEY

SEQ ID NO: 4162 - protein, 9 aa, Borrelia DbpA
GEDEFKELY

SEQ ID NO: 4163 - protein, 9 aa, Borrelia DbpA
DEFKELYEL

SEQ ID NO: 4164 - protein, 9 aa, Borrelia DbpA
YELMLKISK

SEQ ID NO: 4165 - protein, 10 aa, Borrelia DbpA
EDEFSGIYDL

SEQ ID NO: 4166 - protein, 10 aa, Borrelia DbpA
DEFSGIYDLI

SEQ ID NO: 4167 - protein, 10 aa, Borrelia DbpA
EDEFSGIYDL

SEQ ID NO: 4168 - protein, 10 aa, Borrelia DbpA
DEFSGIYDLI

SEQ ID NO: 4169 - protein, 10 aa, Borrelia DbpA
EDEFKELYEL

SEQ ID NO: 4170 - protein, 10 aa, Borrelia DbpA
DEFKELYELM

SEQ ID NO: 4171 - protein, 11 aa, Borrelia DbpA
LEATEEETITF

SEQ ID NO: 4172 - protein, 11 aa, Borrelia DbpA
DEFSGIYDLIL

SEQ ID NO: 4173 - protein, 11 aa, Borrelia DbpA
DEFSGIYDLIY

SEQ ID NO: 4174 - protein, 11 aa, Borrelia DbpA
GEDEFKELYEL

SEQ ID NO: 4175 - protein, 11 aa, Borrelia DbpA
EDEFKELYELM

SEQ ID NO: 4176 - protein, 11 aa, Borrelia DbpA
DEFKELYELML

SEQ ID NO: 4177 - protein, 12 aa, Borrelia DbpA
EDEFSGIYDLIL

SEQ ID NO: 4178 - protein, 12 aa, Borrelia DbpA
DEFSGIYDLILN

SEQ ID NO: 4179 - protein, 12 aa, Borrelia DbpA
EDEFSGIYDLIY

SEQ ID NO: 4180 - protein, 12 aa, Borrelia DbpA
DEFSGIYDLIYR

SEQ ID NO: 4181 - protein, 12 aa, Borrelia DbpA
DEIDAIKKDAAL

SEQ ID NO: 4182 - protein, 12 aa, Borrelia DbpA
AGEDEFKELYEL

SEQ ID NO: 4183 - protein, 12 aa, Borrelia DbpA
GEDEFKELYELM

SEQ ID NO: 4184 - protein, 12 aa, Borrelia DbpA
EDEFKELYELML

SEQ ID NO: 4185 - protein, 12 aa, Borrelia DbpA
DEFKELYELMLK

SEQ ID NO: 4186 - protein, 9 aa, Borrelia DbpA
DAGVKTDAF

SEQ ID NO: 4187 - protein, 9 aa, Borrelia DbpA
RVADLTIKF

SEQ ID NO: 4188 - protein, 9 aa, Borrelia DbpA
QAIQVAGKF

SEQ ID NO: 4189 - protein, 9 aa, Borrelia DbpA
FSAMYDLML

SEQ ID NO: 4190 - protein, 9 aa, Borrelia DbpA
QAAEKTPPT

SEQ ID NO: 4191 - protein, 9 aa, Borrelia DbpA
QAAEKTPPT

SEQ ID NO: 4192 - protein, 9 aa, Borrelia DbpA
QAIQVAEKF

SEQ ID NO: 4193 - protein, 9 aa, Borrelia DbpA
FSAMYDLML

SEQ ID NO: 4194 - protein, 9 aa, Borrelia DbpA
DAGVNTDAF

SEQ ID NO: 4195 - protein, 9 aa, Borrelia DbpA
LVADLTIEF

SEQ ID NO: 4196 - protein, 9 aa, Borrelia DbpA
FSGIYDLIY

SEQ ID NO: 4197 - protein, 9 aa, Borrelia DbpA
FSAMYDLML

SEQ ID NO: 4198 - protein, 9 aa, Borrelia DbpA
MIKCNNKTF

SEQ ID NO: 4199 - protein, 9 aa, Borrelia DbpA
FVIAIEEEA

SEQ ID NO: 4200 - protein, 9 aa, Borrelia DbpA
FSAMYDLMF

SEQ ID NO: 4201 - protein, 9 aa, Borrelia DbpA
LMFEVSKPL

SEQ ID NO: 4202 - protein, 9 aa, Borrelia DbpA
MIKCNNKTF

SEQ ID NO: 4203 - protein, 9 aa, Borrelia DbpA
EAASMGVNF

SEQ ID NO: 4204 - protein, 9 aa, Borrelia DbpA
FSAMYDLMF

SEQ ID NO: 4205 - protein, 9 aa, Borrelia DbpA
LMFEVSKPL

SEQ ID NO: 4206 - protein, 10 aa, Borrelia DbpA
EATEEETITF

SEQ ID NO: 4207 - protein, 9 aa, Borrelia DbpA
DEFSGIYDL

SEQ ID NO: 4208 - protein, 9 aa, Borrelia DbpA
IEIVKVMKA

SEQ ID NO: 4209 - protein, 9 aa, Borrelia DbpA
EDFSGIYDL

SEQ ID NO: 4210 - protein, 9 aa, Borrelia DbpA
KEGVNFEAF

SEQ ID NO: 4211 - protein, 9 aa, Borrelia DbpA
PEFILKAKI

SEQ ID NO: 4212 - protein, 9 aa, Borrelia DbpA
HEALKNLEG

SEQ ID NO: 4213 - protein, 9 aa, Borrelia DbpA
KEIEEEANI

SEQ ID NO: 4214 - protein, 9 aa, Borrelia DbpA
QEMIKTVTQ

SEQ ID NO: 4215 - protein, 9 aa, Borrelia DbpA
AEKTPPTTV

SEQ ID NO: 4216 - protein, 9 aa, Borrelia DbpA
GETKIRLES

SEQ ID NO: 4217 - protein, 9 aa, Borrelia DbpA
KEGVKFEAF

SEQ ID NO: 4218 - protein, 9 aa, Borrelia DbpA
PEFILKAKI

SEQ ID NO: 4219 - protein, 9 aa, Borrelia DbpA
AEKTPATTA

SEQ ID NO: 4220 - protein, 9 aa, Borrelia DbpA
AEGILAIAQ

SEQ ID NO: 4221 - protein, 9 aa, Borrelia DbpA
KEKANTAAT

SEQ ID NO: 4222 - protein, 9 aa, Borrelia DbpA
IEFLKATEE

SEQ ID NO: 4223 - protein, 9 aa, Borrelia DbpA
DEFSGIYDL

SEQ ID NO: 4224 - protein, 9 aa, Borrelia DbpA
GETKIRLES

SEQ ID NO: 4225 - protein, 9 aa, Borrelia DbpA
KEGVKFEAF

SEQ ID NO: 4226 - protein, 9 aa, Borrelia DbpA
PEFILKAKI

SEQ ID NO: 4227 - protein, 9 aa, Borrelia DbpA
KEAEKTPPT

SEQ ID NO: 4228 - protein, 9 aa, Borrelia DbpA
AEGILAIAQ

SEQ ID NO: 4229 - protein, 9 aa, Borrelia DbpA
SENPFILEA

SEQ ID NO: 4230 - protein, 9 aa, Borrelia DbpA
KETGSSGEF

SEQ ID NO: 4231 - protein, 9 aa, Borrelia DbpA
GEFSAMYDL

SEQ ID NO: 4232 - protein, 9 aa, Borrelia DbpA
AMYDLMFEV

SEQ ID NO: 4233 - protein, 9 aa, Borrelia DbpA
REKLQRVHT

SEQ ID NO: 4234 - protein, 9 aa, Borrelia DbpA
REAKLRIIA

SEQ ID NO: 4235 - protein, 9 aa, Borrelia DbpA
DEFKELYEL

SEQ ID NO: 4236 - protein, 9 aa, Borrelia DbpA
YELMLKISK

SEQ ID NO: 4237 - protein, 9 aa, Borrelia DbpA
SESRAGNFI

SEQ ID NO: 4238 - protein, 9 aa, Borrelia DbpA
KETGSSGEF

SEQ ID NO: 4239 - protein, 9 aa, Borrelia DbpA
GEFSAMYDL

SEQ ID NO: 4240 - protein, 9 aa, Borrelia DbpA
AMYDLMFEV

SEQ ID NO: 4241 - protein, 9 aa, Borrelia DbpA
QELGIQDMT

SEQ ID NO: 4242 - protein, 9 aa, Borrelia DbpA
REKLIRVKG

SEQ ID NO: 4243 - protein, 10 aa, Borrelia DbpA
KENGAGEDEF

SEQ ID NO: 4244 - protein, 10 aa, Borrelia DbpA
EDEFSGIYDL

SEQ ID NO: 4245 - protein, 10 aa, Borrelia DbpA
DEFSGIYDLI

SEQ ID NO: 4246 - protein, 10 aa, Borrelia DbpA
EEDFSGIYDL

SEQ ID NO: 4247 - protein, 10 aa, Borrelia DbpA
KPEFILKAKI

SEQ ID NO: 4248 - protein, 10 aa, Borrelia DbpA
AEGILAIAKA

SEQ ID NO: 4249 - protein, 10 aa, Borrelia DbpA
KEAIADGVKL

SEQ ID NO: 4250 - protein, 10 aa, Borrelia DbpA
KEIEEEANIL

SEQ ID NO: 4251 - protein, 10 aa, Borrelia DbpA
QEMIKTVTQA

SEQ ID NO: 4252 - protein, 10 aa, Borrelia DbpA
VEGILMIANT

SEQ ID NO: 4253 - protein, 10 aa, Borrelia DbpA
KPEFILKAKI

SEQ ID NO: 4254 - protein, 10 aa, Borrelia DbpA
AEGILAIAQA

SEQ ID NO: 4255 - protein, 10 aa, Borrelia DbpA
KENGAGEDEF

SEQ ID NO: 4256 - protein, 10 aa, Borrelia DbpA
EDEFSGIYDL

SEQ ID NO: 4257 - protein, 10 aa, Borrelia DbpA
DEFSGIYDLI

SEQ ID NO: 4258 - protein, 10 aa, Borrelia DbpA
KPEFILKAKI

SEQ ID NO: 4259 - protein, 10 aa, Borrelia DbpA
KEAEKTPPTT

SEQ ID NO: 4260 - protein, 10 aa, Borrelia DbpA
AEGILAIAQA

SEQ ID NO: 4261 - protein, 10 aa, Borrelia DbpA
LEAKVRATTV

SEQ ID NO: 4262 - protein, 10 aa, Borrelia DbpA
AEKFVIAIEE

SEQ ID NO: 4263 - protein, 10 aa, Borrelia DbpA
SGEFSAMYDL

SEQ ID NO: 4264 - protein, 10 aa, Borrelia DbpA
GEFSAMYDLM

SEQ ID NO: 4265 - protein, 10 aa, Borrelia DbpA
FEVSKPLQKL

SEQ ID NO: 4266 - protein, 10 aa, Borrelia DbpA
QEMTKTVSDA

SEQ ID NO: 4267 - protein, 10 aa, Borrelia DbpA
TREAKLRIIA

SEQ ID NO: 4268 - protein, 10 aa, Borrelia DbpA
REAKLRIIAL

SEQ ID NO: 4269 - protein, 10 aa, Borrelia DbpA
KETKEEAIKL

SEQ ID NO: 4270 - protein, 10 aa, Borrelia DbpA
KEYGAGEDEF

SEQ ID NO: 4271 - protein, 10 aa, Borrelia DbpA
EDEFKELYEL

SEQ ID NO: 4272 - protein, 10 aa, Borrelia DbpA
DEFKELYELM

SEQ ID NO: 4273 - protein, 10 aa, Borrelia DbpA
KELYELMLKI

SEQ ID NO: 4274 - protein, 10 aa, Borrelia DbpA
YELMLKISKA

SEQ ID NO: 4275 - protein, 10 aa, Borrelia DbpA
KEAASMGVNF

SEQ ID NO: 4276 - protein, 10 aa, Borrelia DbpA
SGEFSAMYDL

SEQ ID NO: 4277 - protein, 10 aa, Borrelia DbpA
GEFSAMYDLM

SEQ ID NO: 4278 - protein, 10 aa, Borrelia DbpA
FEVSKPLQEL

SEQ ID NO: 4279 - protein, 11 aa, Borrelia DbpA
GEDEFSGIYDL

SEQ ID NO: 4280 - protein, 11 aa, Borrelia DbpA
GEEDFSGIYDL

SEQ ID NO: 4281 - protein, 11 aa, Borrelia DbpA
VEGILMIANTI

SEQ ID NO: 4282 - protein, 11 aa, Borrelia DbpA
AEGILAIAQAM

SEQ ID NO: 4283 - protein, 11 aa, Borrelia DbpA
GEDEFSGIYDL

SEQ ID NO: 4284 - protein, 11 aa, Borrelia DbpA
AEGILAIAQAM

SEQ ID NO: 4285 - protein, 11 aa, Borrelia DbpA
KETGSSGEFSA

SEQ ID NO: 4286 - protein, 11 aa, Borrelia DbpA
SSGEFSAMYDL

SEQ ID NO: 4287 - protein, 11 aa, Borrelia DbpA
SGEFSAMYDLM

SEQ ID NO: 4288 - protein, 11 aa, Borrelia DbpA
GEFSAMYDLMF

SEQ ID NO: 4289 - protein, 11 aa, Borrelia DbpA
TREAKLRIIAL

SEQ ID NO: 4290 - protein, 11 aa, Borrelia DbpA
REAKLRIIALT

SEQ ID NO: 4291 - protein, 11 aa, Borrelia DbpA
GEDEFKELYEL

SEQ ID NO: 4292 - protein, 11 aa, Borrelia DbpA
EDEFKELYELM

SEQ ID NO: 4293 - protein, 11 aa, Borrelia DbpA
FKELYELMLKI

SEQ ID NO: 4294 - protein, 11 aa, Borrelia DbpA
KELYELMLKIS

SEQ ID NO: 4295 - protein, 11 aa, Borrelia DbpA
YELMLKISKAV

SEQ ID NO: 4296 - protein, 11 aa, Borrelia DbpA
KETGSSGEFSA

SEQ ID NO: 4297 - protein, 11 aa, Borrelia DbpA
SSGEFSAMYDL

SEQ ID NO: 4298 - protein, 11 aa, Borrelia DbpA
SGEFSAMYDLM

SEQ ID NO: 4299 - protein, 11 aa, Borrelia DbpA
GEFSAMYDLMF

SEQ ID NO: 4300 - protein, 12 aa, Borrelia DbpA
AGEDEFSGIYDL

SEQ ID NO: 4301 - protein, 12 aa, Borrelia DbpA
GEDEFSGIYDLI

SEQ ID NO: 4302 - protein, 12 aa, Borrelia DbpA
AGEEDFSGIYDL

SEQ ID NO: 4303 - protein, 12 aa, Borrelia DbpA
GEEDFSGIYDLI

SEQ ID NO: 4304 - protein, 12 aa, Borrelia DbpA
IEFLKATEEETI

SEQ ID NO: 4305 - protein, 12 aa, Borrelia DbpA
AGEDEFSGIYDL

SEQ ID NO: 4306 - protein, 12 aa, Borrelia DbpA
GEDEFSGIYDLI

SEQ ID NO: 4307 - protein, 12 aa, Borrelia DbpA
GSSGEFSAMYDL

SEQ ID NO: 4308 - protein, 12 aa, Borrelia DbpA
SSGEFSAMYDLM

SEQ ID NO: 4309 - protein, 12 aa, Borrelia DbpA
SGEFSAMYDLMF

SEQ ID NO: 4310 - protein, 12 aa, Borrelia DbpA
GEFSAMYDLMFE

SEQ ID NO: 4311 - protein, 12 aa, Borrelia DbpA
KTREAKLRIIAL

SEQ ID NO: 4312 - protein, 12 aa, Borrelia DbpA
TREAKLRIIALT

SEQ ID NO: 4313 - protein, 12 aa, Borrelia DbpA
REAKLRIIALTL

SEQ ID NO: 4314 - protein, 12 aa, Borrelia DbpA
AGEDEFKELYEL

SEQ ID NO: 4315 - protein, 12 aa, Borrelia DbpA
GEDEFKELYELM

SEQ ID NO: 4316 - protein, 12 aa, Borrelia DbpA
EFKELYELMLKI

SEQ ID NO: 4317 - protein, 12 aa, Borrelia DbpA
FKELYELMLKIS

SEQ ID NO: 4318 - protein, 12 aa, Borrelia DbpA
KELYELMLKISK

SEQ ID NO: 4319 - protein, 12 aa, Borrelia DbpA
LYELMLKISKAV

SEQ ID NO: 4320 - protein, 12 aa, Borrelia DbpA
YELMLKISKAVE

SEQ ID NO: 4321 - protein, 12 aa, Borrelia DbpA
KEAASMGVNFDA

SEQ ID NO: 4322 - protein, 12 aa, Borrelia DbpA
GSSGEFSAMYDL

SEQ ID NO: 4323 - protein, 12 aa, Borrelia DbpA
SSGEFSAMYDLM

SEQ ID NO: 4324 - protein, 12 aa, Borrelia DbpA
SGEFSAMYDLMF

SEQ ID NO: 4325 - protein, 12 aa, Borrelia DbpA
GEFSAMYDLMFE

SEQ ID NO: 4326 - protein, 9 aa, Borrelia DbpA
KEGVNFEAF

SEQ ID NO: 4327 - protein, 9 aa, Borrelia DbpA
AEGILAIAK

SEQ ID NO: 4328 - protein, 9 aa, Borrelia DbpA
QEMIKTVTQ

SEQ ID NO: 4329 - protein, 9 aa, Borrelia DbpA
KEGVKFEAF

SEQ ID NO: 4330 - protein, 9 aa, Borrelia DbpA
AEGILAIAQ

SEQ ID NO: 4331 - protein, 9 aa, Borrelia DbpA
AEAVEKIGM

SEQ ID NO: 4332 - protein, 9 aa, Borrelia DbpA
KEGVKFEAF

SEQ ID NO: 4333 - protein, 9 aa, Borrelia DbpA
AEGILAIAQ

SEQ ID NO: 4334 - protein, 9 aa, Borrelia DbpA
SENPFILEA

SEQ ID NO: 4335 - protein, 9 aa, Borrelia DbpA
KETGSSGEF

SEQ ID NO: 4336 - protein, 9 aa, Borrelia DbpA
GEFSAMYDL

SEQ ID NO: 4337 - protein, 9 aa, Borrelia DbpA
EEAIKLKEY

SEQ ID NO: 4338 - protein, 9 aa, Borrelia DbpA
SESRAGNFI

SEQ ID NO: 4339 - protein, 9 aa, Borrelia DbpA
KETGSSGEF

SEQ ID NO: 4340 - protein, 9 aa, Borrelia DbpA
GEFSAMYDL

SEQ ID NO: 4341 - protein, 10 aa, Borrelia DbpA
KENGAGEDEF

SEQ ID NO: 4342 - protein, 10 aa, Borrelia DbpA
KENGAGEEDF

SEQ ID NO: 4343 - protein, 10 aa, Borrelia DbpA
AVEKIGMQGM

SEQ ID NO: 4344 - protein, 10 aa, Borrelia DbpA
QEIKDEINKI

SEQ ID NO: 4345 - protein, 10 aa, Borrelia DbpA
KPEFILKAKI

SEQ ID NO: 4346 - protein, 10 aa, Borrelia DbpA
AEGILAIAKA

SEQ ID NO: 4347 - protein, 10 aa, Borrelia DbpA
QEMIKTVTQA

SEQ ID NO: 4348 - protein, 10 aa, Borrelia DbpA
QEIKDEINKI

SEQ ID NO: 4349 - protein, 10 aa, Borrelia DbpA
KPEFILKAKI

SEQ ID NO: 4350 - protein, 10 aa, Borrelia DbpA
AEGILAIAQA

SEQ ID NO: 4351 - protein, 10 aa, Borrelia DbpA
KENGAGEDEF

SEQ ID NO: 4352 - protein, 10 aa, Borrelia DbpA
QEIKDEINKI

SEQ ID NO: 4353 - protein, 10 aa, Borrelia DbpA
KPEFILKAKI

SEQ ID NO: 4354 - protein, 10 aa, Borrelia DbpA
AEGILAIAQA

SEQ ID NO: 4355 - protein, 10 aa, Borrelia DbpA
SGEFSAMYDL

SEQ ID NO: 4356 - protein, 10 aa, Borrelia DbpA
GEFSAMYDLM

SEQ ID NO: 4357 - protein, 10 aa, Borrelia DbpA
QEMTKTVSDA

SEQ ID NO: 4358 - protein, 10 aa, Borrelia DbpA
QEGGVDTNAF

SEQ ID NO: 4359 - protein, 10 aa, Borrelia DbpA
REAKLRIIAL

SEQ ID NO: 4360 - protein, 10 aa, Borrelia DbpA
KEEAIKLKEY

SEQ ID NO: 4361 - protein, 10 aa, Borrelia DbpA
KEYGAGEDEF

SEQ ID NO: 4362 - protein, 10 aa, Borrelia DbpA
KELYELMLKI

SEQ ID NO: 4363 - protein, 10 aa, Borrelia DbpA
AVEGIGIQNM

SEQ ID NO: 4364 - protein, 10 aa, Borrelia DbpA
KEAASMGVNF

SEQ ID NO: 4365 - protein, 10 aa, Borrelia DbpA
SGEFSAMYDL

SEQ ID NO: 4366 - protein, 10 aa, Borrelia DbpA
GEFSAMYDLM

SEQ ID NO: 4367 - protein, 11 aa, Borrelia DbpA
AEGILAIAKAM

SEQ ID NO: 4368 - protein, 11 aa, Borrelia DbpA
QEMIKTVTQAA

SEQ ID NO: 4369 - protein, 11 aa, Borrelia DbpA
AEGILAIAQAM

SEQ ID NO: 4370 - protein, 12 aa, Borrelia DbpA
TAEGILAIAQAM

SEQ ID NO: 4371 - protein, 12 aa, Borrelia DbpA
AEGILAIAQAME

SEQ ID NO: 4372 - protein, 9 aa, Borrelia DbpA
IEIVKVMKA

SEQ ID NO: 4373 - protein, 9 aa, Borrelia DbpA
AEKTPPTTA

SEQ ID NO: 4374 - protein, 9 aa, Borrelia DbpA
AEGILAIAK

SEQ ID NO: 4375 - protein, 9 aa, Borrelia DbpA
AEKTPPTTV

SEQ ID NO: 4376 - protein, 9 aa, Borrelia DbpA
AEKTPATTA

SEQ ID NO: 4377 - protein, 9 aa, Borrelia DbpA
AEGILAIAQ

SEQ ID NO: 4378 - protein, 9 aa, Borrelia DbpA
KEKANTAAT

SEQ ID NO: 4379 - protein, 9 aa, Borrelia DbpA
NEIDKAIKA

SEQ ID NO: 4380 - protein, 9 aa, Borrelia DbpA
KEAEKTPPT

SEQ ID NO: 4381 - protein, 9 aa, Borrelia DbpA
AEKTPPTTA

SEQ ID NO: 4382 - protein, 9 aa, Borrelia DbpA
AEGILAIAQ

SEQ ID NO: 4383 - protein, 9 aa, Borrelia DbpA
LEEKANTAA

SEQ ID NO: 4384 - protein, 9 aa, Borrelia DbpA
EEKANTAAT

SEQ ID NO: 4385 - protein, 9 aa, Borrelia DbpA
SENPFILEA

SEQ ID NO: 4386 - protein, 9 aa, Borrelia DbpA
AEKFVIAIE

SEQ ID NO: 4387 - protein, 9 aa, Borrelia DbpA
AEENPPTTA

SEQ ID NO: 4388 - protein, 9 aa, Borrelia DbpA
QEGGVDTNA

SEQ ID NO: 4389 - protein, 9 aa, Borrelia DbpA
REAKLRIIA

SEQ ID NO: 4390 - protein, 9 aa, Borrelia DbpA
SESRAGNFI

SEQ ID NO: 4391 - protein, 9 aa, Borrelia DbpA
AEKFLTAIE

SEQ ID NO: 4392 - protein, 10 aa, Borrelia DbpA
AEDAGVKTDA

SEQ ID NO: 4393 - protein, 10 aa, Borrelia DbpA
TETQTGGKVA

SEQ ID NO: 4394 - protein, 10 aa, Borrelia DbpA
KEGVNFEAFT

SEQ ID NO: 4395 - protein, 10 aa, Borrelia DbpA
AAEKTPPTTA

SEQ ID NO: 4396 - protein, 10 aa, Borrelia DbpA
AEKTPPTTAE

SEQ ID NO: 4397 - protein, 10 aa, Borrelia DbpA
AEGILAIAKA

SEQ ID NO: 4398 - protein, 10 aa, Borrelia DbpA
QEMIKTVTQA

SEQ ID NO: 4399 - protein, 10 aa, Borrelia DbpA
KEGVKFEAFT

SEQ ID NO: 4400 - protein, 10 aa, Borrelia DbpA
SEKPEFILKA

SEQ ID NO: 4401 - protein, 10 aa, Borrelia DbpA
VAEKTPATTA

SEQ ID NO: 4402 - protein, 10 aa, Borrelia DbpA
AEKTPATTAE

SEQ ID NO: 4403 - protein, 10 aa, Borrelia DbpA
AEGILAIAQA

SEQ ID NO: 4404 - protein, 10 aa, Borrelia DbpA
NEIDKAIKAA

SEQ ID NO: 4405 - protein, 10 aa, Borrelia DbpA
TETQTGGKVA

SEQ ID NO: 4406 - protein, 10 aa, Borrelia DbpA
KEGVKFEAFT

SEQ ID NO: 4407 - protein, 10 aa, Borrelia DbpA
SEKPEFILKA

SEQ ID NO: 4408 - protein, 10 aa, Borrelia DbpA
EAEKTPPTTA

SEQ ID NO: 4409 - protein, 10 aa, Borrelia DbpA
AEKTPPTTAE

SEQ ID NO: 4410 - protein, 10 aa, Borrelia DbpA
AEGILAIAQA

SEQ ID NO: 4411 - protein, 10 aa, Borrelia DbpA
NLEEKANTAA

SEQ ID NO: 4412 - protein, 10 aa, Borrelia DbpA
EEKANTAATT

SEQ ID NO: 4413 - protein, 10 aa, Borrelia DbpA
VSENPFILEA

SEQ ID NO: 4414 - protein, 10 aa, Borrelia DbpA
SENPFILEAK

SEQ ID NO: 4415 - protein, 10 aa, Borrelia DbpA
QEMTKTVSDA

SEQ ID NO: 4416 - protein, 10 aa, Borrelia DbpA
AAEENPPTTA

SEQ ID NO: 4417 - protein, 10 aa, Borrelia DbpA
AEENPPTTAQ

SEQ ID NO: 4418 - protein, 10 aa, Borrelia DbpA
NEIDKAIKEA

SEQ ID NO: 4419 - protein, 10 aa, Borrelia DbpA
AQEGGVDTNA

SEQ ID NO: 4420 - protein, 10 aa, Borrelia DbpA
QEGGVDTNAF

SEQ ID NO: 4421 - protein, 10 aa, Borrelia DbpA
TREAKLRIIA

SEQ ID NO: 4422 - protein, 10 aa, Borrelia DbpA
REAKLRIIAL

SEQ ID NO: 4423 - protein, 10 aa, Borrelia DbpA
YELMLKISKA

SEQ ID NO: 4424 - protein, 11 aa, Borrelia DbpA
EAEDAGVKTDA

SEQ ID NO: 4425 - protein, 11 aa, Borrelia DbpA
TAEGILAIAKA

SEQ ID NO: 4426 - protein, 11 aa, Borrelia DbpA
AEGILAIAKAM

SEQ ID NO: 4427 - protein, 11 aa, Borrelia DbpA
LQEMIKTVTQA

SEQ ID NO: 4428 - protein, 11 aa, Borrelia DbpA
QEMIKTVTQAA

SEQ ID NO: 4429 - protein, 11 aa, Borrelia DbpA
VSEKPEFILKA

SEQ ID NO: 4430 - protein, 11 aa, Borrelia DbpA
SEKPEFILKAK

SEQ ID NO: 4431 - protein, 11 aa, Borrelia DbpA
TAEGILAIAQA

SEQ ID NO: 4432 - protein, 11 aa, Borrelia DbpA
AEGILAIAQAM

SEQ ID NO: 4433 - protein, 11 aa, Borrelia DbpA
VSEKPEFILKA

SEQ ID NO: 4434 - protein, 11 aa, Borrelia DbpA
SEKPEFILKAK

SEQ ID NO: 4435 - protein, 11 aa, Borrelia DbpA
TAEGILAIAQA

SEQ ID NO: 4436 - protein, 11 aa, Borrelia DbpA
AEGILAIAQAM

SEQ ID NO: 4437 - protein, 11 aa, Borrelia DbpA
GVSENPFILEA

SEQ ID NO: 4438 - protein, 11 aa, Borrelia DbpA
VSENPFILEAK

SEQ ID NO: 4439 - protein, 11 aa, Borrelia DbpA
SENPFILEAKV

SEQ ID NO: 4440 - protein, 11 aa, Borrelia DbpA
KETGSSGEFSA

SEQ ID NO: 4441 - protein, 11 aa, Borrelia DbpA
IQEMTKTVSDA

SEQ ID NO: 4442 - protein, 11 aa, Borrelia DbpA
QEMTKTVSDAA

SEQ ID NO: 4443 - protein, 11 aa, Borrelia DbpA
KETGSSGEFSA

SEQ ID NO: 4444 - protein, 12 aa, Borrelia DbpA
KEAEDAGVKTDA

SEQ ID NO: 4445 - protein, 12 aa, Borrelia DbpA
EEAAKENPKTTA

SEQ ID NO: 4446 - protein, 12 aa, Borrelia DbpA
TTAEGILAIAKA

SEQ ID NO: 4447 - protein, 12 aa, Borrelia DbpA
TAEGILAIAKAM

SEQ ID NO: 4448 - protein, 12 aa, Borrelia DbpA
AEGILAIAKAME

SEQ ID NO: 4449 - protein, 11 aa, Borrelia DbpA
QEMIKTVTQAA

SEQ ID NO: 4450 - protein, 11 aa, Borrelia DbpA
QEMIKTVTQAA

SEQ ID NO: 4451 - protein, 11 aa, Borrelia DbpA
QEMIKTVTQAA

SEQ ID NO: 4452 - protein, 12 aa, Borrelia DbpA
KVSEKPEFILKA

SEQ ID NO: 4453 - protein, 12 aa, Borrelia DbpA
AEKFVKAIKEEA

SEQ ID NO: 4454 - protein, 12 aa, Borrelia DbpA
TTAEGILAIAQA

SEQ ID NO: 4455 - protein, 12 aa, Borrelia DbpA
TAEGILAIAQAM

SEQ ID NO: 4456 - protein, 12 aa, Borrelia DbpA
AEGILAIAQAME

SEQ ID NO: 4457 - protein, 12 aa, Borrelia DbpA
KVSEKPEFILKA

SEQ ID NO: 4458 - protein, 12 aa, Borrelia DbpA
AEKFVKAIKEEA

SEQ ID NO: 4459 - protein, 12 aa, Borrelia DbpA
TTAEGILAIAQA

SEQ ID NO: 4460 - protein, 12 aa, Borrelia DbpA
TAEGILAIAQAM

SEQ ID NO: 4461 - protein, 12 aa, Borrelia DbpA
AEGILAIAQAME

SEQ ID NO: 4462 - protein, 12 aa, Borrelia DbpA
SGVSENPFILEA

SEQ ID NO: 4463 - protein, 12 aa, Borrelia DbpA
GVSENPFILEAK

SEQ ID NO: 4464 - protein, 12 aa, Borrelia DbpA
VSENPFILEAKV

SEQ ID NO: 4465 - protein, 12 aa, Borrelia DbpA
SENPFILEAKVR

SEQ ID NO: 4466 - protein, 12 aa, Borrelia DbpA
AEKFVIAIEEEA

SEQ ID NO: 4467 - protein, 12 aa, Borrelia DbpA
GIQEMTKTVSDA

SEQ ID NO: 4468 - protein, 12 aa, Borrelia DbpA
IQEMTKTVSDAA

SEQ ID NO: 4469 - protein, 12 aa, Borrelia DbpA
QEMTKTVSDAAE

SEQ ID NO: 4470 - protein, 12 aa, Borrelia DbpA
KEAASMGVNFDA

SEQ ID NO: 4471 - protein, 12 aa, Borrelia DbpA
AEKFLTAIEEEA

SEQ ID NO: 4472 - protein, 9 aa, Borrelia FIhF
FSLSDLDDY

SEQ ID NO: 4473 - protein, 10 aa, Borrelia FIhF
WVEVSGYVRY

SEQ ID NO: 4474 - protein, 10 aa, Borrelia FIhF
TTIAKLAAIY

SEQ ID NO: 4475 - protein, 11 aa, Borrelia FIhF
DWVEVSGYVRY

SEQ ID NO: 4476 - protein, 12 aa, Borrelia FIhF
KDWVEVSGYVRY

SEQ ID NO: 4477 - protein, 12 aa, Borrelia FIhF
TTCVGNLISLIY

SEQ ID NO: 4478 - protein, 9 aa, Borrelia FIhF
SIEDVLKEV

SEQ ID NO: 4479 - protein, 9 aa, Borrelia FIhF
YIKDINEFI

SEQ ID NO: 4480 - protein, 9 aa, Borrelia FIhF
FILVGPTGV

SEQ ID NO: 4481 - protein, 9 aa, Borrelia FIhF
SLNIKIITI

SEQ ID NO: 4482 - protein, 9 aa, Borrelia FIhF
QTYGDIMGI

SEQ ID NO: 4483 - protein, 9 aa, Borrelia FIhF
KLAEMKELL

SEQ ID NO: 4484 - protein, 9 aa, Borrelia FIhF
NLISLIYEM

SEQ ID NO: 4485 - protein, 9 aa, Borrelia FIhF
SLIYEMKKV

SEQ ID NO: 4486 - protein, 9 aa, Borrelia FIhF
QIVPHNISV

SEQ ID NO: 4487 - protein, 9 aa, Borrelia FIhF
SVAEPLTFI

SEQ ID NO: 4488 - protein, 9 aa, Borrelia FIhF
RISDDAEFI

SEQ ID NO: 4489 - protein, 10 aa, Borrelia FIhF
ILGLFSKDWV

SEQ ID NO: 4490 - protein, 10 aa, Borrelia FIhF
GLFSKDWVEV

SEQ ID NO: 4491 - protein, 10 aa, Borrelia FIhF
VFILVGPTGV

SEQ ID NO: 4492 - protein, 10 aa, Borrelia FIhF
FILVGPTGVG

SEQ ID NO: 4493 - protein, 10 aa, Borrelia FIhF
KSLNIKIITI

SEQ ID NO: 4494 - protein, 10 aa, Borrelia FIhF
IQTYGDIMGI

SEQ ID NO: 4495 - protein, 10 aa, Borrelia FIhF
FMKLAEMKEL

SEQ ID NO: 4496 - protein, 10 aa, Borrelia FIhF
MKLAEMKELL

SEQ ID NO: 4497 - protein, 10 aa, Borrelia FIhF
GNLISLIYEM

SEQ ID NO: 4498 - protein, 10 aa, Borrelia FIhF
NLISLIYEMK

SEQ ID NO: 4499 - protein, 10 aa, Borrelia FIhF
YEMKKVVSYV

SEQ ID NO: 4500 - protein, 10 aa, Borrelia FIhF
YRISDDAEFI

SEQ ID NO: 4501 - protein, 11 aa, Borrelia FIhF
LGLFSKDWVEV

SEQ ID NO: 4502 - protein, 11 aa, Borrelia FIhF
GLFSKDWVEVS

SEQ ID NO: 4503 - protein, 11 aa, Borrelia FIhF
SLSDLDDYERV

SEQ ID NO: 4504 - protein, 11 aa, Borrelia FIhF
FMKLAEMKELL

SEQ ID NO: 4505 - protein, 11 aa, Borrelia FIhF
KLAEMKELLNA

SEQ ID NO: 4506 - protein, 11 aa, Borrelia FIhF
VGNLISLIYEM

SEQ ID NO: 4507 - protein, 12 aa, Borrelia FIhF
ILGLFSKDWVEV

SEQ ID NO: 4508 - protein, 12 aa, Borrelia FIhF
LGLFSKDWVEVS

SEQ ID NO: 4509 - protein, 12 aa, Borrelia FIhF
GLFSKDWVEVSG

SEQ ID NO: 4510 - protein, 12 aa, Borrelia FIhF
FSLSDLDDYERV

SEQ ID NO: 4511 - protein, 12 aa, Borrelia FIhF
MKLAEMKELLNA

SEQ ID NO: 4512 - protein, 12 aa, Borrelia FIhF
CVGNLISLIYEM

SEQ ID NO: 4513 - protein, 12 aa, Borrelia FIhF
NLISLIYEMKKV

SEQ ID NO: 4514 - protein, 12 aa, Borrelia FIhF
LIYEMKKVVSYV

SEQ ID NO: 4515 - protein, 9 aa, Borrelia FIhF
KNARVMTYK

SEQ ID NO: 4516 - protein, 9 aa, Borrelia FIhF
VLKEVKSLK

SEQ ID NO: 4517 - protein, 9 aa, Borrelia FIhF
SLKTELAHK

SEQ ID NO: 4518 - protein, 9 aa, Borrelia FIhF
NINHPTITK

SEQ ID NO: 4519 - protein, 9 aa, Borrelia FIhF
RVREDVVLY

SEQ ID NO: 4520 - protein, 9 aa, Borrelia FIhF
VLYIAKTIK

SEQ ID NO: 4521 - protein, 9 aa, Borrelia FIhF
LVGPTGVGK

SEQ ID NO: 4522 - protein, 9 aa, Borrelia FIhF
PVRAIESFK

SEQ ID NO: 4523 - protein, 9 aa, Borrelia FIhF
LILVDTIGK

SEQ ID NO: 4524 - protein, 9 aa, Borrelia FIhF
HLAVSSTTK

SEQ ID NO: 4525 - protein, 9 aa, Borrelia FIhF
HQFSPFNYK

SEQ ID NO: 4526 - protein, 9 aa, Borrelia FIhF
LISLIYEMK

SEQ ID NO: 4527 - protein, 9 aa, Borrelia FIhF
ISLIYEMKK

SEQ ID NO: 4528 - protein, 10 aa, Borrelia FIhF
IEIIKKKYGK

SEQ ID NO: 4529 - protein, 10 aa, Borrelia FIhF
RVMTYKTIPH

SEQ ID NO: 4530 - protein, 10 aa, Borrelia FIhF
DVLKEVKSLK

SEQ ID NO: 4531 - protein, 10 aa, Borrelia FIhF
KSLKTELAHK

SEQ ID NO: 4532 - protein, 10 aa, Borrelia FIhF
SLKTELAHKK

SEQ ID NO: 4533 - protein, 10 aa, Borrelia FIhF
ENINHPTITK

SEQ ID NO: 4534 - protein, 10 aa, Borrelia FIhF
VVLYIAKTIK

SEQ ID NO: 4535 - protein, 10 aa, Borrelia FIhF
VLYIAKTIKC

SEQ ID NO: 4536 - protein, 10 aa, Borrelia FIhF
ILVGPTGVGK

SEQ ID NO: 4537 - protein, 10 aa, Borrelia FIhF
GVGKTTTIAK

SEQ ID NO: 4538 - protein, 10 aa, Borrelia FIhF
AIYGINGESK

SEQ ID NO: 4539 - protein, 10 aa, Borrelia FIhF
TIDNYRIGAK

SEQ ID NO: 4540 - protein, 10 aa, Borrelia FIhF
IPVRAIESFK

SEQ ID NO: 4541 - protein, 10 aa, Borrelia FIhF
RAIESFKDLK

SEQ ID NO: 4542 - protein, 10 aa, Borrelia FIhF
LVDTIGKSPK

SEQ ID NO: 4543 - protein, 10 aa, Borrelia FIhF
FHLAVSSTTK

SEQ ID NO: 4544 - protein, 10 aa, Borrelia FIhF
HLAVSSTTKT

SEQ ID NO: 4545 - protein, 10 aa, Borrelia FIhF
SSTTKTSDVK

SEQ ID NO: 4546 - protein, 10 aa, Borrelia FIhF
FHQFSPFNYK

SEQ ID NO: 4547 - protein, 10 aa, Borrelia FIhF
HQFSPFNYKT

SEQ ID NO: 4548 - protein, 10 aa, Borrelia FIhF
FNYKTVIFTK

SEQ ID NO: 4549 - protein, 10 aa, Borrelia FIhF
NLISLIYEMK

SEQ ID NO: 4550 - protein, 10 aa, Borrelia FIhF
LISLIYEMKK

SEQ ID NO: 4551 - protein, 10 aa, Borrelia FIhF
SVAEPLTFIR

SEQ ID NO: 4552 - protein, 10 aa, Borrelia FIhF
RISDDAEFIK

SEQ ID NO: 4553 - protein, 10 aa, Borrelia FIhF
RVMTYKTVPH

SEQ ID NO: 4554 - protein, 11 aa, Borrelia FIhF
KENINHPTITK

SEQ ID NO: 4555 - protein, 11 aa, Borrelia FIhF
AAIYGINGESK

SEQ ID NO: 4556 - protein, 11 aa, Borrelia FIhF
AIYGINGESKS

SEQ ID NO: 4557 - protein, 11 aa, Borrelia FIhF
ITIDNYRIGAK

SEQ ID NO: 4558 - protein, 11 aa, Borrelia FIhF
TIDNYRIGAKK

SEQ ID NO: 4559 - protein, 11 aa, Borrelia FIhF
IFHQFSPFNYK

SEQ ID NO: 4560 - protein, 11 aa, Borrelia FIhF
RISDDAEFIKK

SEQ ID NO: 4561 - protein, 12 aa, Borrelia FIhF
KKENINHPTITK

SEQ ID NO: 4562 - protein, 12 aa, Borrelia FIhF
KENINHPTITKI

SEQ ID NO: 4563 - protein, 12 aa, Borrelia FIhF
RVREDVVLYIAK

SEQ ID NO: 4564 - protein, 12 aa, Borrelia FIhF
LAAIYGINGESK

SEQ ID NO: 4565 - protein, 12 aa, Borrelia FIhF
IITIDNYRIGAK

SEQ ID NO: 4566 - protein, 12 aa, Borrelia FIhF
ITIDNYRIGAKK

SEQ ID NO: 4567 - protein, 12 aa, Borrelia FIhF
MGIPVRAIESFK

SEQ ID NO: 4568 - protein, 12 aa, Borrelia FIhF
AEFHLAVSSTTK

SEQ ID NO: 4569 - protein, 12 aa, Borrelia FIhF
EIFHQFSPFNYK

SEQ ID NO: 4570 - protein, 9 aa, Borrelia FIhF
KNARVMTYK

SEQ ID NO: 4571 - protein, 9 aa, Borrelia FIhF
GGILGLFSK

SEQ ID NO: 4572 - protein, 9 aa, Borrelia FIhF
QQINVEDEK

SEQ ID NO: 4573 - protein, 9 aa, Borrelia FIhF
NSSIEDVLK

SEQ ID NO: 4574 - protein, 9 aa, Borrelia FIhF
VLKEVKSLK

SEQ ID NO: 4575 - protein, 9 aa, Borrelia FIhF
SLKTELAHK

SEQ ID NO: 4576 - protein, 9 aa, Borrelia FIhF
NINHPTITK

SEQ ID NO: 4577 - protein, 9 aa, Borrelia FIhF
VLYIAKTIK

SEQ ID NO: 4578 - protein, 9 aa, Borrelia FIhF
SGSIIDDLK

SEQ ID NO: 4579 - protein, 9 aa, Borrelia FIhF
GSIIDDLKK

SEQ ID NO: 4580 - protein, 9 aa, Borrelia FIhF
LVGPTGVGK

SEQ ID NO: 4581 - protein, 9 aa, Borrelia FIhF
VGKTTTIAK

SEQ ID NO: 4582 - protein, 9 aa, Borrelia FIhF
KIITIDNYR

SEQ ID NO: 4583 - protein, 9 aa, Borrelia FIhF
AIESFKDLK

SEQ ID NO: 4584 - protein, 9 aa, Borrelia FIhF
LILVDTIGK

SEQ ID NO: 4585 - protein, 9 aa, Borrelia FIhF
HLAVSSTTK

SEQ ID NO: 4586 - protein, 9 aa, Borrelia FIhF
STTKTSDVK

SEQ ID NO: 4587 - protein, 9 aa, Borrelia FIhF
HQFSPFNYK

SEQ ID NO: 4588 - protein, 9 aa, Borrelia FIhF
LISLIYEMK

SEQ ID NO: 4589 - protein, 9 aa, Borrelia FIhF
ISLIYEMKK

SEQ ID NO: 4590 - protein, 9 aa, Borrelia FIhF
ISDDAEFIK

SEQ ID NO: 4591 - protein, 9 aa, Borrelia FIhF
SDDAEFIKK

SEQ ID NO: 4592 - protein, 9 aa, Borrelia FIhF
SGSIIDNLK

SEQ ID NO: 4593 - protein, 9 aa, Borrelia FIhF
GSIIDNLKK

SEQ ID NO: 4594 - protein, 9 aa, Borrelia FIhF
SIIDNLKKR

SEQ ID NO: 4595 - protein, 10 aa, Borrelia FIhF
IEIIKKKYGK

SEQ ID NO: 4596 - protein, 10 aa, Borrelia FIhF
RVMTYKTIPH

SEQ ID NO: 4597 - protein, 10 aa, Borrelia FIhF
HGGILGLFSK

SEQ ID NO: 4598 - protein, 10 aa, Borrelia FIhF
SIEDVLKEVK

SEQ ID NO: 4599 - protein, 10 aa, Borrelia FIhF
KSLKTELAHK

SEQ ID NO: 4600 - protein, 10 aa, Borrelia FIhF
SLKTELAHKK

SEQ ID NO: 4601 - protein, 10 aa, Borrelia FIhF
ENINHPTITK

SEQ ID NO: 4602 - protein, 10 aa, Borrelia FIhF
YIKDINEFIK

SEQ ID NO: 4603 - protein, 10 aa, Borrelia FIhF
VVLYIAKTIK

SEQ ID NO: 4604 - protein, 10 aa, Borrelia FIhF
CSGSIIDDLK

SEQ ID NO: 4605 - protein, 10 aa, Borrelia FIhF
SGSIIDDLKK

SEQ ID NO: 4606 - protein, 10 aa, Borrelia FIhF
ILVGPTGVGK

SEQ ID NO: 4607 - protein, 10 aa, Borrelia FIhF
GVGKTTTIAK

SEQ ID NO: 4608 - protein, 10 aa, Borrelia FIhF
TTIAKLAAIY

SEQ ID NO: 4609 - protein, 10 aa, Borrelia FIhF
AIYGINGESK

SEQ ID NO: 4610 - protein, 10 aa, Borrelia FIhF
TIDNYRIGAK

SEQ ID NO: 4611 - protein, 10 aa, Borrelia FIhF
IPVRAIESFK

SEQ ID NO: 4612 - protein, 10 aa, Borrelia FIhF
RAIESFKDLK

SEQ ID NO: 4613 - protein, 10 aa, Borrelia FIhF
LVDTIGKSPK

SEQ ID NO: 4614 - protein, 10 aa, Borrelia FIhF
SSTTKTSDVK

SEQ ID NO: 4615 - protein, 10 aa, Borrelia FIhF
FHQFSPFNYK

SEQ ID NO: 4616 - protein, 10 aa, Borrelia FIhF
HQFSPFNYKT

SEQ ID NO: 4617 - protein, 10 aa, Borrelia FIhF
FNYKTVIFTK

SEQ ID NO: 4618 - protein, 10 aa, Borrelia FIhF
NLISLIYEMK

SEQ ID NO: 4619 - protein, 10 aa, Borrelia FIhF
LISLIYEMKK

SEQ ID NO: 4620 - protein, 10 aa, Borrelia FIhF
SVAEPLTFIR

SEQ ID NO: 4621 - protein, 10 aa, Borrelia FIhF
LTFIRRINGY

SEQ ID NO: 4622 - protein, 10 aa, Borrelia FIhF
RISDDAEFIK

SEQ ID NO: 4623 - protein, 10 aa, Borrelia FIhF
ISDDAEFIKK

SEQ ID NO: 4624 - protein, 10 aa, Borrelia FIhF
RVMTYKTVPH

SEQ ID NO: 4625 - protein, 10 aa, Borrelia FIhF
CSGSIIDNLK

SEQ ID NO: 4626 - protein, 10 aa, Borrelia FIhF
SGSIIDNLKK

SEQ ID NO: 4627 - protein, 11 aa, Borrelia FIhF
SSIEDVLKEVK

SEQ ID NO: 4628 - protein, 11 aa, Borrelia FIhF
KSLKTELAHKK

SEQ ID NO: 4629 - protein, 11 aa, Borrelia FIhF
KENINHPTITK

SEQ ID NO: 4630 - protein, 11 aa, Borrelia FIhF
AAIYGINGESK

SEQ ID NO: 4631 - protein, 11 aa, Borrelia FIhF
ITIDNYRIGAK

SEQ ID NO: 4632 - protein, 11 aa, Borrelia FIhF
TIDNYRIGAKK

SEQ ID NO: 4633 - protein, 11 aa, Borrelia FIhF
TIGKSPKDFMK

SEQ ID NO: 4634 - protein, 11 aa, Borrelia FIhF
IFHQFSPFNYK

SEQ ID NO: 4635 - protein, 11 aa, Borrelia FIhF
NLISLIYEMKK

SEQ ID NO: 4636 - protein, 11 aa, Borrelia FIhF
ISVAEPLTFIR

SEQ ID NO: 4637 - protein, 11 aa, Borrelia FIhF
LTFIRRINGYR

SEQ ID NO: 4638 - protein, 11 aa, Borrelia FIhF
YRISDDAEFIK

SEQ ID NO: 4639 - protein, 11 aa, Borrelia FIhF
RISDDAEFIKK

SEQ ID NO: 4640 - protein, 11 aa, Borrelia FIhF
CSGSIIDNLKK

SEQ ID NO: 4641 - protein, 12 aa, Borrelia FIhF
NSSIEDVLKEVK

SEQ ID NO: 4642 - protein, 12 aa, Borrelia FIhF
KKENINHPTITK

SEQ ID NO: 4643 - protein, 12 aa, Borrelia FIhF
RVREDVVLYIAK

SEQ ID NO: 4644 - protein, 12 aa, Borrelia FIhF
LAAIYGINGESK

SEQ ID NO: 4645 - protein, 12 aa, Borrelia FIhF
IITIDNYRIGAK

SEQ ID NO: 4646 - protein, 12 aa, Borrelia FIhF
ITIDNYRIGAKK

SEQ ID NO: 4647 - protein, 12 aa, Borrelia FIhF
DTIGKSPKDFMK

SEQ ID NO: 4648 - protein, 12 aa, Borrelia FIhF
AVSSTTKTSDVK

SEQ ID NO: 4649 - protein, 12 aa, Borrelia FIhF
EIFHQFSPFNYK

SEQ ID NO: 4650 - protein, 12 aa, Borrelia FIhF
IFHQFSPFNYKT

SEQ ID NO: 4651 - protein, 12 aa, Borrelia FIhF
GNLISLIYEMKK

SEQ ID NO: 4652 - protein, 12 aa, Borrelia FIhF
NISVAEPLTFIR

SEQ ID NO: 4653 - protein, 12 aa, Borrelia FIhF
GYRISDDAEFIK

SEQ ID NO: 4654 - protein, 12 aa, Borrelia FIhF
YRISDDAEFIKK

SEQ ID NO: 4655 - protein, 12 aa, Borrelia FIhF
KCSGSIIDNLKK

SEQ ID NO: 4656 - protein, 9 aa, Borrelia FIhF
TYNEVIEII

SEQ ID NO: 4657 - protein, 9 aa, Borrelia FIhF
NYIKDINEF

SEQ ID NO: 4658 - protein, 9 aa, Borrelia FIhF
ISVAEPLTF

SEQ ID NO: 4659 - protein, 10 aa, Borrelia FIhF
TYKTIPHGGI

SEQ ID NO: 4660 - protein, 10 aa, Borrelia FIhF
ENYIKDINEF

SEQ ID NO: 4661 - protein, 10 aa, Borrelia FIhF
NYIKDINEFI

SEQ ID NO: 4662 - protein, 10 aa, Borrelia FIhF
NYKTVIFTKV

SEQ ID NO: 4663 - protein, 10 aa, Borrelia FIhF
TYKTVPHGGI

SEQ ID NO: 4664 - protein, 12 aa, Borrelia FIhF
FSENYIKDINEF

SEQ ID NO: 4665 - protein, 12 aa, Borrelia FIhF
FSENYIKDINEF

SEQ ID NO: 4666 - protein, 9 aa, Borrelia FIhF
EVIEIIKKK

SEQ ID NO: 4667 - protein, 9 aa, Borrelia FIhF
TTIAKLAAI

SEQ ID NO: 4668 - protein, 9 aa, Borrelia FIhF
DVKEIFHQF

SEQ ID NO: 4669 - protein, 9 aa, Borrelia FIhF
EIFHQFSPF

SEQ ID NO: 4670 - protein, 10 aa, Borrelia FIhF
EVIEIIKKKY

SEQ ID NO: 4671 - protein, 9 aa, Borrelia FIhF
EVIEIIKKK

SEQ ID NO: 4672 - protein, 9 aa, Borrelia FIhF
TTIAKLAAI

SEQ ID NO: 4673 - protein, 9 aa, Borrelia FIhF
TIAKLAAIY

SEQ ID NO: 4674 - protein, 9 aa, Borrelia FIhF
DVKEIFHQF

SEQ ID NO: 4675 - protein, 9 aa, Borrelia FIhF
EIFHQFSPF

SEQ ID NO: 4676 - protein, 10 aa, Borrelia FIhF
EVIEIIKKKY

SEQ ID NO: 4677 - protein, 10 aa, Borrelia FIhF
ERVREDVVLY

SEQ ID NO: 4678 - protein, 10 aa, Borrelia FIhF
TTIAKLAAIY

SEQ ID NO: 4679 - protein, 10 aa, Borrelia FIhF
DTIGKSPKDF

SEQ ID NO: 4680 - protein, 10 aa, Borrelia FIhF
EIFHQFSPFN

SEQ ID NO: 4681 - protein, 10 aa, Borrelia FIhF
LTFIRRINGY

SEQ ID NO: 4682 - protein, 11 aa, Borrelia FIhF
NEVIEIIKKKY

SEQ ID NO: 4683 - protein, 11 aa, Borrelia FIhF
EVIEIIKKKYG

SEQ ID NO: 4684 - protein, 11 aa, Borrelia FIhF
TTIAKLAAIYG

SEQ ID NO: 4685 - protein, 11 aa, Borrelia FIhF
EIFHQFSPFNY

SEQ ID NO: 4686 - protein, 12 aa, Borrelia FIhF
YNEVIEIIKKKY

SEQ ID NO: 4687 - protein, 12 aa, Borrelia FIhF
NEVIEIIKKKYG

SEQ ID NO: 4688 - protein, 12 aa, Borrelia FIhF
EVIEIIKKKYGK

SEQ ID NO: 4689 - protein, 12 aa, Borrelia FIhF
DVKEIFHQFSPF

SEQ ID NO: 4690 - protein, 12 aa, Borrelia FIhF
EIFHQFSPFNYK

SEQ ID NO: 4691 - protein, 9 aa, Borrelia FIhF
YFTEKGPTY

SEQ ID NO: 4692 - protein, 9 aa, Borrelia FIhF
VEVSGYVRY

SEQ ID NO: 4693 - protein, 9 aa, Borrelia FIhF
FSLSDLDDY

SEQ ID NO: 4694 - protein, 9 aa, Borrelia FIhF
RVREDVVLY

SEQ ID NO: 4695 - protein, 9 aa, Borrelia FIhF
TIAKLAAIY

SEQ ID NO: 4696 - protein, 9 aa, Borrelia FIhF
FHQFSPFNY

SEQ ID NO: 4697 - protein, 9 aa, Borrelia FIhF
VGNLISLIY

SEQ ID NO: 4698 - protein, 9 aa, Borrelia FIhF
NLISLIYEM

SEQ ID NO: 4699 - protein, 9 aa, Borrelia FIhF
TFIRRINGY

SEQ ID NO: 4700 - protein, 10 aa, Borrelia FIhF
QYFTEKGPTY

SEQ ID NO: 4701 - protein, 10 aa, Borrelia FIhF
YFTEKGPTYN

SEQ ID NO: 4702 - protein, 10 aa, Borrelia FIhF
WVEVSGYVRY

SEQ ID NO: 4703 - protein, 10 aa, Borrelia FIhF
EFSLSDLDDY

SEQ ID NO: 4704 - protein, 10 aa, Borrelia FIhF
TTIAKLAAIY

SEQ ID NO: 4705 - protein, 10 aa, Borrelia FIhF
IFHQFSPFNY

SEQ ID NO: 4706 - protein, 10 aa, Borrelia FIhF
FHQFSPFNYK

SEQ ID NO: 4707 - protein, 10 aa, Borrelia FIhF
CVGNLISLIY

SEQ ID NO: 4708 - protein, 10 aa, Borrelia FIhF
LTFIRRINGY

SEQ ID NO: 4709 - protein, 11 aa, Borrelia FIhF
VQYFTEKGPTY

SEQ ID NO: 4710 - protein, 11 aa, Borrelia FIhF
DWVEVSGYVRY

SEQ ID NO: 4711 - protein, 11 aa, Borrelia FIhF
EIFHQFSPFNY

SEQ ID NO: 4712 - protein, 11 aa, Borrelia FIhF
IFHQFSPFNYK

SEQ ID NO: 4713 - protein, 12 aa, Borrelia FIhF
MVQYFTEKGPTY

SEQ ID NO: 4714 - protein, 12 aa, Borrelia FIhF
KDWVEVSGYVRY

SEQ ID NO: 4715 - protein, 12 aa, Borrelia FIhF
DYERVREDVVLY

SEQ ID NO: 4716 - protein, 12 aa, Borrelia FIhF
KEIFHQFSPFNY

SEQ ID NO: 4717 - protein, 12 aa, Borrelia FIhF
EIFHQFSPFNYK

SEQ ID NO: 4718 - protein, 12 aa, Borrelia FIhF
IFHQFSPFNYKT

SEQ ID NO: 4719 - protein, 9 aa, Borrelia FIhF
KKKYGKNAR

SEQ ID NO: 4720 - protein, 9 aa, Borrelia FIhF
KNARVMTYK

SEQ ID NO: 4721 - protein, 9 aa, Borrelia FIhF
VLKEVKSLK

SEQ ID NO: 4722 - protein, 9 aa, Borrelia FIhF
ITKIEDILR

SEQ ID NO: 4723 - protein, 9 aa, Borrelia FIhF
KDINEFIKR

SEQ ID NO: 4724 - protein, 9 aa, Borrelia FIhF
KIITIDNYR

SEQ ID NO: 4725 - protein, 9 aa, Borrelia FIhF
HQFSPFNYK

SEQ ID NO: 4726 - protein, 9 aa, Borrelia FIhF
NYKTVIFTK

SEQ ID NO: 4727 - protein, 9 aa, Borrelia FIhF
VAEPLTFIR

SEQ ID NO: 4728 - protein, 9 aa, Borrelia FIhF
FIRRINGYR

SEQ ID NO: 4729 - protein, 9 aa, Borrelia FIhF
SIIDNLKKR

SEQ ID NO: 4730 - protein, 10 aa, Borrelia FIhF
RVMTYKTIPH

SEQ ID NO: 4731 - protein, 10 aa, Borrelia FIhF
KSLKTELAHK

SEQ ID NO: 4732 - protein, 10 aa, Borrelia FIhF
TITKIEDILR

SEQ ID NO: 4733 - protein, 10 aa, Borrelia FIhF
SLSDLDDYER

SEQ ID NO: 4734 - protein, 10 aa, Borrelia FIhF
IKIITIDNYR

SEQ ID NO: 4735 - protein, 10 aa, Borrelia FIhF
KIITIDNYRI

SEQ ID NO: 4736 - protein, 10 aa, Borrelia FIhF
IPVRAIESFK

SEQ ID NO: 4737 - protein, 10 aa, Borrelia FIhF
RAIESFKDLK

SEQ ID NO: 4738 - protein, 10 aa, Borrelia FIhF
KDFMKLAEMK

SEQ ID NO: 4739 - protein, 10 aa, Borrelia FIhF
FHQFSPFNYK

SEQ ID NO: 4740 - protein, 10 aa, Borrelia FIhF
FNYKTVIFTK

SEQ ID NO: 4741 - protein, 10 aa, Borrelia FIhF
SVAEPLTFIR

SEQ ID NO: 4742 - protein, 10 aa, Borrelia FIhF
TFIRRINGYR

SEQ ID NO: 4743 - protein, 10 aa, Borrelia FIhF
FIRRINGYRI

SEQ ID NO: 4744 - protein, 10 aa, Borrelia FIhF
RVMTYKTVPH

SEQ ID NO: 4745 - protein, 11 aa, Borrelia FIhF
IIKKKYGKNAR

SEQ ID NO: 4746 - protein, 11 aa, Borrelia FIhF
YIKDINEFIKR

SEQ ID NO: 4747 - protein, 11 aa, Borrelia FIhF
NIKIITIDNYR

SEQ ID NO: 4748 - protein, 11 aa, Borrelia FIhF
IFHQFSPFNYK

SEQ ID NO: 4749 - protein, 11 aa, Borrelia FIhF
ISVAEPLTFIR

SEQ ID NO: 4750 - protein, 11 aa, Borrelia FIhF
LTFIRRINGYR

SEQ ID NO: 4751 - protein, 11 aa, Borrelia FIhF
TFIRRINGYRI

SEQ ID NO: 4752 - protein, 12 aa, Borrelia FIhF
EIIKKKYGKNAR

SEQ ID NO: 4753 - protein, 12 aa, Borrelia FIhF
KYGKNARVMTYK

SEQ ID NO: 4754 - protein, 12 aa, Borrelia FIhF
NYIKDINEFIKR

SEQ ID NO: 4755 - protein, 12 aa, Borrelia FIhF
RVREDVVLYIAK

SEQ ID NO: 4756 - protein, 12 aa, Borrelia FIhF
LNIKIITIDNYR

SEQ ID NO: 4757 - protein, 12 aa, Borrelia FIhF
MGIPVRAIESFK

SEQ ID NO: 4758 - protein, 12 aa, Borrelia FIhF
EIFHQFSPFNYK

SEQ ID NO: 4759 - protein, 12 aa, Borrelia FIhF
NISVAEPLTFIR

SEQ ID NO: 4760 - protein, 12 aa, Borrelia FIhF
ISVAEPLTFIRR

SEQ ID NO: 4761 - protein, 12 aa, Borrelia FIhF
PLTFIRRINGYR

SEQ ID NO: 4762 - protein, 12 aa, Borrelia FIhF
LTFIRRINGYRI

SEQ ID NO: 4763 - protein, 9 aa, Borrelia FIhF
VVLYIAKTI

SEQ ID NO: 4764 - protein, 9 aa, Borrelia FIhF
KTIKCSGSI

SEQ ID NO: 4765 - protein, 9 aa, Borrelia FIhF
TTIAKLAAI

SEQ ID NO: 4766 - protein, 9 aa, Borrelia FIhF
SLNIKIITI

SEQ ID NO: 4767 - protein, 9 aa, Borrelia FIhF
QTYGDIMGI

SEQ ID NO: 4768 - protein, 9 aa, Borrelia FIhF
RDAEFHLAV

SEQ ID NO: 4769 - protein, 9 aa, Borrelia FIhF
KTSDVKEIF

SEQ ID NO: 4770 - protein, 9 aa, Borrelia FIhF
EIFHQFSPF

SEQ ID NO: 4771 - protein, 9 aa, Borrelia FIhF
RINGYRISD

SEQ ID NO: 4772 - protein, 10 aa, Borrelia FIhF
KSLNIKIITI

SEQ ID NO: 4773 - protein, 10 aa, Borrelia FIhF
KIITIDNYRI

SEQ ID NO: 4774 - protein, 10 aa, Borrelia FIhF
KEIFHQFSPF

SEQ ID NO: 4775 - protein, 10 aa, Borrelia FIhF
RVMTYKTVPH

SEQ ID NO: 4776 - protein, 9 aa, Borrelia FIhF
YNEVIEIIK

SEQ ID NO: 4777 - protein, 9 aa, Borrelia FIhF
EVIEIIKKK

SEQ ID NO: 4778 - protein, 9 aa, Borrelia FIhF
EIIKKKYGK

SEQ ID NO: 4779 - protein, 9 aa, Borrelia FIhF
KNARVMTYK

SEQ ID NO: 4780 - protein, 9 aa, Borrelia FIhF
WVEVSGYVR

SEQ ID NO: 4781 - protein, 9 aa, Borrelia FIhF
QQINVEDEK

SEQ ID NO: 4782 - protein, 9 aa, Borrelia FIhF
QINVEDEKR

SEQ ID NO: 4783 - protein, 9 aa, Borrelia FIhF
NSSIEDVLK

SEQ ID NO: 4784 - protein, 9 aa, Borrelia FIhF
NINHPTITK

SEQ ID NO: 4785 - protein, 9 aa, Borrelia FIhF
ITKIEDILR

SEQ ID NO: 4786 - protein, 9 aa, Borrelia FIhF
NDFSENYIK

SEQ ID NO: 4787 - protein, 9 aa, Borrelia FIhF
LSDLDDYER

SEQ ID NO: 4788 - protein, 9 aa, Borrelia FIhF
EDVVLYIAK

SEQ ID NO: 4789 - protein, 9 aa, Borrelia FIhF
SGSIIDDLK

SEQ ID NO: 4790 - protein, 9 aa, Borrelia FIhF
SIIDDLKKR

SEQ ID NO: 4791 - protein, 9 aa, Borrelia FIhF
TIAKLAAIY

SEQ ID NO: 4792 - protein, 9 aa, Borrelia FIhF
KIITIDNYR

SEQ ID NO: 4793 - protein, 9 aa, Borrelia FIhF
DNYRIGAKK

SEQ ID NO: 4794 - protein, 9 aa, Borrelia FIhF
PVRAIESFK

SEQ ID NO: 4795 - protein, 9 aa, Borrelia FIhF
AIESFKDLK

SEQ ID NO: 4796 - protein, 9 aa, Borrelia FIhF
DFMKLAEMK

SEQ ID NO: 4797 - protein, 9 aa, Borrelia FIhF
HLAVSSTTK

SEQ ID NO: 4798 - protein, 9 aa, Borrelia FIhF
STTKTSDVK

SEQ ID NO: 4799 - protein, 9 aa, Borrelia FIhF
HQFSPFNYK

SEQ ID NO: 4800 - protein, 9 aa, Borrelia FIhF
NYKTVIFTK

SEQ ID NO: 4801 - protein, 9 aa, Borrelia FIhF
LISLIYEMK

SEQ ID NO: 4802 - protein, 9 aa, Borrelia FIhF
ISLIYEMKK

SEQ ID NO: 4803 - protein, 9 aa, Borrelia FIhF
VAEPLTFIR

SEQ ID NO: 4804 - protein, 9 aa, Borrelia FIhF
FIRRINGYR

SEQ ID NO: 4805 - protein, 9 aa, Borrelia FIhF
ISDDAEFIK

SEQ ID NO: 4806 - protein, 9 aa, Borrelia FIhF
DAEFIKKIK

SEQ ID NO: 4807 - protein, 9 aa, Borrelia FIhF
SGSIIDNLK

SEQ ID NO: 4808 - protein, 9 aa, Borrelia FIhF
SIIDNLKKR

SEQ ID NO: 4809 - protein, 10 aa, Borrelia FIhF
NEVIEIIKKK

SEQ ID NO: 4810 - protein, 10 aa, Borrelia FIhF
EVIEIIKKKY

SEQ ID NO: 4811 - protein, 10 aa, Borrelia FIhF
DWVEVSGYVR

SEQ ID NO: 4812 - protein, 10 aa, Borrelia FIhF
QQINVEDEKR

SEQ ID NO: 4813 - protein, 10 aa, Borrelia FIhF
ENSSIEDVLK

SEQ ID NO: 4814 - protein, 10 aa, Borrelia FIhF
SIEDVLKEVK

SEQ ID NO: 4815 - protein, 10 aa, Borrelia FIhF
DVLKEVKSLK

SEQ ID NO: 4816 - protein, 10 aa, Borrelia FIhF
ENINHPTITK

SEQ ID NO: 4817 - protein, 10 aa, Borrelia FIhF
TITKIEDILR

SEQ ID NO: 4818 - protein, 10 aa, Borrelia FIhF
ENDFSENYIK

SEQ ID NO: 4819 - protein, 10 aa, Borrelia FIhF
YIKDINEFIK

SEQ ID NO: 4820 - protein, 10 aa, Borrelia FIhF
SLSDLDDYER

SEQ ID NO: 4821 - protein, 10 aa, Borrelia FIhF
VVLYIAKTIK

SEQ ID NO: 4822 - protein, 10 aa, Borrelia FIhF
CSGSIIDDLK

SEQ ID NO: 4823 - protein, 10 aa, Borrelia FIhF
TTIAKLAAIY

SEQ ID NO: 4824 - protein, 10 aa, Borrelia FIhF
AIYGINGESK

SEQ ID NO: 4825 - protein, 10 aa, Borrelia FIhF
IKIITIDNYR

SEQ ID NO: 4826 - protein, 10 aa, Borrelia FIhF
TIDNYRIGAK

SEQ ID NO: 4827 - protein, 10 aa, Borrelia FIhF
IPVRAIESFK

SEQ ID NO: 4828 - protein, 10 aa, Borrelia FIhF
RAIESFKDLK

SEQ ID NO: 4829 - protein, 10 aa, Borrelia FIhF
DLILVDTIGK

SEQ ID NO: 4830 - protein, 10 aa, Borrelia FIhF
LVDTIGKSPK

SEQ ID NO: 4831 - protein, 10 aa, Borrelia FIhF
FHLAVSSTTK

SEQ ID NO: 4832 - protein, 10 aa, Borrelia FIhF
SSTTKTSDVK

SEQ ID NO: 4833 - protein, 10 aa, Borrelia FIhF
FHQFSPFNYK

SEQ ID NO: 4834 - protein, 10 aa, Borrelia FIhF
FNYKTVIFTK

SEQ ID NO: 4835 - protein, 10 aa, Borrelia FIhF
NLISLIYEMK

SEQ ID NO: 4836 - protein, 10 aa, Borrelia FIhF
LISLIYEMKK

SEQ ID NO: 4837 - protein, 10 aa, Borrelia FIhF
SVAEPLTFIR

SEQ ID NO: 4838 - protein, 10 aa, Borrelia FIhF
VAEPLTFIRR

SEQ ID NO: 4839 - protein, 10 aa, Borrelia FIhF
TFIRRINGYR

SEQ ID NO: 4840 - protein, 10 aa, Borrelia FIhF
RISDDAEFIK

SEQ ID NO: 4841 - protein, 10 aa, Borrelia FIhF
CSGSIIDNLK

SEQ ID NO: 4842 - protein, 11 aa, Borrelia FIhF
PTITKIEDILR

SEQ ID NO: 4843 - protein, 11 aa, Borrelia FIhF
NYIKDINEFIK

SEQ ID NO: 4844 - protein, 11 aa, Borrelia FIhF
YIKDINEFIKR

SEQ ID NO: 4845 - protein, 11 aa, Borrelia FIhF
NIKIITIDNYR

SEQ ID NO: 4846 - protein, 11 aa, Borrelia FIhF
ISVAEPLTFIR

SEQ ID NO: 4847 - protein, 11 aa, Borrelia FIhF
SVAEPLTFIRR

SEQ ID NO: 4848 - protein, 11 aa, Borrelia FIhF
LTFIRRINGYR

SEQ ID NO: 4849 - protein, 12 aa, Borrelia FIhF
EVIEIIKKKYGK

SEQ ID NO: 4850 - protein, 12 aa, Borrelia FIhF
EIIKKKYGKNAR

SEQ ID NO: 4851 - protein, 12 aa, Borrelia FIhF
HPTITKIEDILR

SEQ ID NO: 4852 - protein, 12 aa, Borrelia FIhF
ENYIKDINEFIK

SEQ ID NO: 4853 - protein, 12 aa, Borrelia FIhF
NYIKDINEFIKR

SEQ ID NO: 4854 - protein, 12 aa, Borrelia FIhF
LNIKIITIDNYR

SEQ ID NO: 4855 - protein, 12 aa, Borrelia FIhF
NIKIITIDNYRI

SEQ ID NO: 4856 - protein, 12 aa, Borrelia FIhF
ITIDNYRIGAKK

SEQ ID NO: 4857 - protein, 12 aa, Borrelia FIhF
QTYGDIMGIPVR

SEQ ID NO: 4858 - protein, 12 aa, Borrelia FIhF
MGIPVRAIESFK

SEQ ID NO: 4859 - protein, 12 aa, Borrelia FIhF
DTIGKSPKDFMK

SEQ ID NO: 4860 - protein, 12 aa, Borrelia FIhF
EIFHQFSPFNYK

SEQ ID NO: 4861 - protein, 12 aa, Borrelia FIhF
NISVAEPLTFIR

SEQ ID NO: 4862 - protein, 12 aa, Borrelia FIhF
ISVAEPLTFIRR

SEQ ID NO: 4863 - protein, 12 aa, Borrelia FIhF
PLTFIRRINGYR

SEQ ID NO: 4864 - protein, 12 aa, Borrelia FIhF
LTFIRRINGYRI

SEQ ID NO: 4865 - protein, 9 aa, Borrelia FIhF
KTIPHGGIL

SEQ ID NO: 4866 - protein, 9 aa, Borrelia FIhF
IPHGGILGL

SEQ ID NO: 4867 - protein, 9 aa, Borrelia FIhF
IPVRAIESF

SEQ ID NO: 4868 - protein, 9 aa, Borrelia FIhF
SPFNYKTVI

SEQ ID NO: 4869 - protein, 9 aa, Borrelia FIhF
KTVPHGGIL

SEQ ID NO: 4870 - protein, 9 aa, Borrelia FIhF
VPHGGILGL

SEQ ID NO: 4871 - protein, 10 aa, Borrelia FIhF
TIPHGGILGL

SEQ ID NO: 4872 - protein, 10 aa, Borrelia FIhF
IPHGGILGLF

SEQ ID NO: 4873 - protein, 10 aa, Borrelia FIhF
FSPFNYKTVI

SEQ ID NO: 4874 - protein, 10 aa, Borrelia FIhF
SPFNYKTVIF

SEQ ID NO: 4875 - protein, 10 aa, Borrelia FIhF
TVPHGGILGL

SEQ ID NO: 4876 - protein, 10 aa, Borrelia FIhF
VPHGGILGLF

SEQ ID NO: 4877 - protein, 11 aa, Borrelia FIhF
KTIPHGGILGL

SEQ ID NO: 4878 - protein, 11 aa, Borrelia FIhF
SPKDFMKLAEM

SEQ ID NO: 4879 - protein, 11 aa, Borrelia FIhF
VPHNISVAEPL

SEQ ID NO: 4880 - protein, 11 aa, Borrelia FIhF
KTVPHGGILGL

SEQ ID NO: 4881 - protein, 9 aa, Borrelia FIhF
EFIKREFSL

SEQ ID NO: 4882 - protein, 9 aa, Borrelia FIhF
DLKKRVFIL

SEQ ID NO: 4883 - protein, 9 aa, Borrelia FIhF
SLNIKIITI

SEQ ID NO: 4884 - protein, 9 aa, Borrelia FIhF
EIFHQFSPF

SEQ ID NO: 4885 - protein, 9 aa, Borrelia FIhF
SPFNYKTVI

SEQ ID NO: 4886 - protein, 9 aa, Borrelia FIhF
NLKKRVFIL

SEQ ID NO: 4887 - protein, 10 aa, Borrelia FIhF
NEFIKREFSL

SEQ ID NO: 4888 - protein, 10 aa, Borrelia FIhF
DDLKKRVFIL

SEQ ID NO: 4889 - protein, 10 aa, Borrelia FIhF
DLKKRVFILV

SEQ ID NO: 4890 - protein, 10 aa, Borrelia FIhF
FSPFNYKTVI

SEQ ID NO: 4891 - protein, 10 aa, Borrelia FIhF
YEMKKVVSYV

SEQ ID NO: 4892 - protein, 10 aa, Borrelia FIhF
FIKKIKSKSY

SEQ ID NO: 4893 - protein, 10 aa, Borrelia FIhF
DNLKKRVFIL

SEQ ID NO: 4894 - protein, 10 aa, Borrelia FIhF
NLKKRVFILV

SEQ ID NO: 4895 - protein, 11 aa, Borrelia FIhF
IDDLKKRVFIL

SEQ ID NO: 4896 - protein, 11 aa, Borrelia FIhF
DNLKKRVFILV

SEQ ID NO: 4897 - protein, 11 aa, Borrelia FIhF
NLKKRVFILVG

SEQ ID NO: 4898 - protein, 12 aa, Borrelia FIhF
IIDDLKKRVFIL

SEQ ID NO: 4899 - protein, 12 aa, Borrelia FIhF
KSPKDFMKLAEM

SEQ ID NO: 4900 - protein, 12 aa, Borrelia FIhF
IIDNLKKRVFIL

SEQ ID NO: 4901 - protein, 12 aa, Borrelia FIhF
IDNLKKRVFILV

SEQ ID NO: 4902 - protein, 12 aa, Borrelia FIhF
DNLKKRVFILVG

SEQ ID NO: 4903 - protein, 12 aa, Borrelia FIhF
NLKKRVFILVGP

SEQ ID NO: 4904 - protein, 9 aa, Borrelia FIhF
YFTEKGPTY

SEQ ID NO: 4905 - protein, 9 aa, Borrelia FIhF
IKKKYGKNA

SEQ ID NO: 4906 - protein, 9 aa, Borrelia FIhF
KKYGKNARV

SEQ ID NO: 4907 - protein, 9 aa, Borrelia FIhF
GKNARVMTY

SEQ ID NO: 4908 - protein, 9 aa, Borrelia FIhF
ARVMTYKTI

SEQ ID NO: 4909 - protein, 9 aa, Borrelia FIhF
VMTYKTIPH

SEQ ID NO: 4910 - protein, 9 aa, Borrelia FIhF
KTIPHGGIL

SEQ ID NO: 4911 - protein, 9 aa, Borrelia FIhF
KDWVEVSGY

SEQ ID NO: 4912 - protein, 9 aa, Borrelia FIhF
VEVSGYVRY

SEQ ID NO: 4913 - protein, 9 aa, Borrelia FIhF
EKRKILQSI

SEQ ID NO: 4914 - protein, 9 aa, Borrelia FIhF
IKREENSSI

SEQ ID NO: 4915 - protein, 9 aa, Borrelia FIhF
KSLKTELAH

SEQ ID NO: 4916 - protein, 9 aa, Borrelia FIhF
INHPTITKI

SEQ ID NO: 4917 - protein, 9 aa, Borrelia FIhF
RENDFSENY

SEQ ID NO: 4918 - protein, 9 aa, Borrelia FIhF
IKREFSLSD

SEQ ID NO: 4919 - protein, 9 aa, Borrelia FIhF
FSLSDLDDY

SEQ ID NO: 4920 - protein, 9 aa, Borrelia FIhF
RVREDVVLY

SEQ ID NO: 4921 - protein, 9 aa, Borrelia FIhF
KTIKCSGSI

SEQ ID NO: 4922 - protein, 9 aa, Borrelia FIhF
KKRVFILVG

SEQ ID NO: 4923 - protein, 9 aa, Borrelia FIhF
GKTTTIAKL

SEQ ID NO: 4924 - protein, 9 aa, Borrelia FIhF
TIAKLAAIY

SEQ ID NO: 4925 - protein, 9 aa, Borrelia FIhF
AKLAAIYGI

SEQ ID NO: 4926 - protein, 9 aa, Borrelia FIhF
SKSLNIKII

SEQ ID NO: 4927 - protein, 9 aa, Borrelia FIhF
IKIITIDNY

SEQ ID NO: 4928 - protein, 9 aa, Borrelia FIhF
GAKKQIQTY

SEQ ID NO: 4929 - protein, 9 aa, Borrelia FIhF
KQIQTYGDI

SEQ ID NO: 4930 - protein, 9 aa, Borrelia FIhF
IMGIPVRAI

SEQ ID NO: 4931 - protein, 9 aa, Borrelia FIhF
RAIESFKDL

SEQ ID NO: 4932 - protein, 9 aa, Borrelia FIhF
KSPKDFMKL

SEQ ID NO: 4933 - protein, 9 aa, Borrelia FIhF
KDFMKLAEM

SEQ ID NO: 4934 - protein, 9 aa, Borrelia FIhF
MKLAEMKEL

SEQ ID NO: 4935 - protein, 9 aa, Borrelia FIhF
KTSDVKEIF

SEQ ID NO: 4936 - protein, 9 aa, Borrelia FIhF
EIFHQFSPF

SEQ ID NO: 4937 - protein, 9 aa, Borrelia FIhF
FHQFSPFNY

SEQ ID NO: 4938 - protein, 9 aa, Borrelia FIhF
HQFSPFNYK

SEQ ID NO: 4939 - protein, 9 aa, Borrelia FIhF
YKTVIFTKV

SEQ ID NO: 4940 - protein, 9 aa, Borrelia FIhF
YEMKKVVSY

SEQ ID NO: 4941 - protein, 9 aa, Borrelia FIhF
KKVVSYVTD

SEQ ID NO: 4942 - protein, 9 aa, Borrelia FIhF
VSYVTDGQI

SEQ ID NO: 4943 - protein, 9 aa, Borrelia FIhF
ISVAEPLTF

SEQ ID NO: 4944 - protein, 9 aa, Borrelia FIhF
YRISDDAEF

SEQ ID NO: 4945 - protein, 9 aa, Borrelia FIhF
IKKIKSKSY

SEQ ID NO: 4946 - protein, 9 aa, Borrelia FIhF
KKIKSKSYY

SEQ ID NO: 4947 - protein, 9 aa, Borrelia FIhF
VMTYKTVPH

SEQ ID NO: 4948 - protein, 9 aa, Borrelia FIhF
KTVPHGGIL

SEQ ID NO: 4949 - protein, 10 aa, Borrelia FIhF
KKYGKNARVM

SEQ ID NO: 4950 - protein, 10 aa, Borrelia FIhF
YGKNARVMTY

SEQ ID NO: 4951 - protein, 10 aa, Borrelia FIhF
KQIQTYGDIM

SEQ ID NO: 4952 - protein, 10 aa, Borrelia FIhF
KEIFHQFSPF

SEQ ID NO: 4953 - protein, 10 aa, Borrelia FIhF
IKKIKSKSYY

SEQ ID NO: 4954 - protein, 11 aa, Borrelia FIhF
VQYFTEKGPTY

SEQ ID NO: 4955 - protein, 11 aa, Borrelia FIhF
VKEIFHQFSPF

SEQ ID NO: 4956 - protein, 11 aa, Borrelia FIhF
KEIFHQFSPFN

SEQ ID NO: 4957 - protein, 12 aa, Borrelia FIhF
MVQYFTEKGPTY

SEQ ID NO: 4958 - protein, 12 aa, Borrelia FIhF
VQYFTEKGPTYN

SEQ ID NO: 4959 - protein, 12 aa, Borrelia FIhF
KKYGKNARVMTY

SEQ ID NO: 4960 - protein, 12 aa, Borrelia FIhF
DVKEIFHQFSPF

SEQ ID NO: 4961 - protein, 12 aa, Borrelia FIhF
VKEIFHQFSPFN

SEQ ID NO: 4962 - protein, 12 aa, Borrelia FIhF
KEIFHQFSPFNY

SEQ ID NO: 4963 - protein, 9 aa, Borrelia FIhF
VEVSGYVRY

SEQ ID NO: 4964 - protein, 9 aa, Borrelia FIhF
RENDFSENY

SEQ ID NO: 4965 - protein, 9 aa, Borrelia FIhF
DEITDSKDF

SEQ ID NO: 4966 - protein, 9 aa, Borrelia FIhF
DETTCVGNL

SEQ ID NO: 4967 - protein, 9 aa, Borrelia FIhF
YEMKKVVSY

SEQ ID NO: 4968 - protein, 10 aa, Borrelia FIhF
IYEMKKVVSY

SEQ ID NO: 4969 - protein, 10 aa, Borrelia FIhF
YEMKKVVSYV

SEQ ID NO: 4970 - protein, 11 aa, Borrelia FIhF
YERVREDVVLY

SEQ ID NO: 4971 - protein, 11 aa, Borrelia FIhF
LIYEMKKVVSY

SEQ ID NO: 4972 - protein, 11 aa, Borrelia FIhF
IYEMKKVVSYV

SEQ ID NO: 4973 - protein, 12 aa, Borrelia FIhF
DYERVREDVVLY

SEQ ID NO: 4974 - protein, 12 aa, Borrelia FIhF
DETTCVGNLISL

SEQ ID NO: 4975 - protein, 12 aa, Borrelia FIhF
SLIYEMKKVVSY

SEQ ID NO: 4976 - protein, 12 aa, Borrelia FIhF
LIYEMKKVVSYV

SEQ ID NO: 4977 - protein, 9 aa, Borrelia FIhF
YFTEKGPTY

SEQ ID NO: 4978 - protein, 9 aa, Borrelia FIhF
IPHGGILGL

SEQ ID NO: 4979 - protein, 9 aa, Borrelia FIhF
FSLSDLDDY

SEQ ID NO: 4980 - protein, 9 aa, Borrelia FIhF
TIAKLAAIY

SEQ ID NO: 4981 - protein, 9 aa, Borrelia FIhF
IPVRAIESF

SEQ ID NO: 4982 - protein, 9 aa, Borrelia FIhF
NACGRDAEF

SEQ ID NO: 4983 - protein, 9 aa, Borrelia FIhF
EIFHQFSPF

SEQ ID NO: 4984 - protein, 9 aa, Borrelia FIhF
VGNLISLIY

SEQ ID NO: 4985 - protein, 9 aa, Borrelia FIhF
NLISLIYEM

SEQ ID NO: 4986 - protein, 9 aa, Borrelia FIhF
YEMKKVVSY

SEQ ID NO: 4987 - protein, 9 aa, Borrelia FIhF
VPHNISVAE

SEQ ID NO: 4988 - protein, 9 aa, Borrelia FIhF
ISVAEPLTF

SEQ ID NO: 4989 - protein, 9 aa, Borrelia FIhF
YRISDDAEF

SEQ ID NO: 4990 - protein, 9 aa, Borrelia FIhF
VPHGGILGL

SEQ ID NO: 4991 - protein, 10 aa, Borrelia FIhF
SPFNYKTVIF

SEQ ID NO: 4992 - protein, 12 aa, Borrelia FIhF
MVQYFTEKGPTY

SEQ ID NO: 4993 - protein, 9 aa, Borrelia FIhF
KENINHPTI

SEQ ID NO: 4994 - protein, 9 aa, Borrelia FIhF
REFSLSDLD

SEQ ID NO: 4995 - protein, 9 aa, Borrelia FIhF
YERVREDVV

SEQ ID NO: 4996 - protein, 9 aa, Borrelia FIhF
REDVVLYIA

SEQ ID NO: 4997 - protein, 9 aa, Borrelia FIhF
FDLILVDTI

SEQ ID NO: 4998 - protein, 9 aa, Borrelia FIhF
KDFMKLAEM

SEQ ID NO: 4999 - protein, 9 aa, Borrelia FIhF
AEMKELLNA

SEQ ID NO: 5000 - protein, 9 aa, Borrelia FIhF
RDAEFHLAV

SEQ ID NO: 5001 - protein, 9 aa, Borrelia FIhF
AEFHLAVSS

SEQ ID NO: 5002 - protein, 9 aa, Borrelia FIhF
KEIFHQFSP

SEQ ID NO: 5003 - protein, 9 aa, Borrelia FIhF
YEMKKVVSY

SEQ ID NO: 5004 - protein, 10 aa, Borrelia FIhF
TEKGPTYNEV

SEQ ID NO: 5005 - protein, 10 aa, Borrelia FIhF
REENSSIEDV

SEQ ID NO: 5006 - protein, 10 aa, Borrelia FIhF
KEVKSLKTEL

SEQ ID NO: 5007 - protein, 10 aa, Borrelia FIhF
KKENINHPTI

SEQ ID NO: 5008 - protein, 10 aa, Borrelia FIhF
KENINHPTIT

SEQ ID NO: 5009 - protein, 10 aa, Borrelia FIhF
RENDFSENYI

SEQ ID NO: 5010 - protein, 10 aa, Borrelia FIhF
NEFIKREFSL

SEQ ID NO: 5011 - protein, 10 aa, Borrelia FIhF
REFSLSDLDD

SEQ ID NO: 5012 - protein, 10 aa, Borrelia FIhF
YERVREDVVL

SEQ ID NO: 5013 - protein, 10 aa, Borrelia FIhF
GESKSLNIKI

SEQ ID NO: 5014 - protein, 10 aa, Borrelia FIhF
LAEMKELLNA

SEQ ID NO: 5015 - protein, 10 aa, Borrelia FIhF
AEMKELLNAC

SEQ ID NO: 5016 - protein, 10 aa, Borrelia FIhF
DAEFHLAVSS

SEQ ID NO: 5017 - protein, 10 aa, Borrelia FIhF
AEFHLAVSST

SEQ ID NO: 5018 - protein, 10 aa, Borrelia FIhF
KEIFHQFSPF

SEQ ID NO: 5019 - protein, 10 aa, Borrelia FIhF
YEMKKVVSYV

SEQ ID NO: 5020 - protein, 11 aa, Borrelia FIhF
RDAEFHLAVSS

SEQ ID NO: 5021 - protein, 11 aa, Borrelia FIhF
DAEFHLAVSST

SEQ ID NO: 5022 - protein, 11 aa, Borrelia FIhF
AEFHLAVSSTT

SEQ ID NO: 5023 - protein, 11 aa, Borrelia FIhF
VKEIFHQFSPF

SEQ ID NO: 5024 - protein, 11 aa, Borrelia FIhF
KEIFHQFSPFN

SEQ ID NO: 5025 - protein, 11 aa, Borrelia FIhF
IYEMKKVVSYV

SEQ ID NO: 5026 - protein, 11 aa, Borrelia FIhF
YEMKKVVSYVT

SEQ ID NO: 5027 - protein, 12 aa, Borrelia FIhF
REDVVLYIAKTI

SEQ ID NO: 5028 - protein, 12 aa, Borrelia FIhF
RDAEFHLAVSST

SEQ ID NO: 5029 - protein, 12 aa, Borrelia FIhF
DAEFHLAVSSTT

SEQ ID NO: 5030 - protein, 12 aa, Borrelia FIhF
AEFHLAVSSTTK

SEQ ID NO: 5031 - protein, 12 aa, Borrelia FIhF
DVKEIFHQFSPF

SEQ ID NO: 5032 - protein, 12 aa, Borrelia FIhF
VKEIFHQFSPFN

SEQ ID NO: 5033 - protein, 12 aa, Borrelia FIhF
KEIFHQFSPFNY

SEQ ID NO: 5034 - protein, 12 aa, Borrelia FIhF
LIYEMKKVVSYV

SEQ ID NO: 5035 - protein, 12 aa, Borrelia FIhF
IYEMKKVVSYVT

SEQ ID NO: 5036 - protein, 12 aa, Borrelia FIhF
YEMKKVVSYVTD

SEQ ID NO: 5037 - protein, 9 aa, Borrelia FIhF
VEVSGYVRY

SEQ ID NO: 5038 - protein, 9 aa, Borrelia FIhF
KENINHPTI

SEQ ID NO: 5039 - protein, 9 aa, Borrelia FIhF
RENDFSENY

SEQ ID NO: 5040 - protein, 9 aa, Borrelia FIhF
DEITDSKDF

SEQ ID NO: 5041 - protein, 9 aa, Borrelia FIhF
AEMKELLNA

SEQ ID NO: 5042 - protein, 9 aa, Borrelia FIhF
AEFHLAVSS

SEQ ID NO: 5043 - protein, 9 aa, Borrelia FIhF
YEMKKVVSY

SEQ ID NO: 5044 - protein, 10 aa, Borrelia FIhF
KKENINHPTI

SEQ ID NO: 5045 - protein, 10 aa, Borrelia FIhF
LRENDFSENY

SEQ ID NO: 5046 - protein, 10 aa, Borrelia FIhF
RENDFSENYI

SEQ ID NO: 5047 - protein, 10 aa, Borrelia FIhF
KDEITDSKDF

SEQ ID NO: 5048 - protein, 10 aa, Borrelia FIhF
AEMKELLNAC

SEQ ID NO: 5049 - protein, 10 aa, Borrelia FIhF
AEFHLAVSST

SEQ ID NO: 5050 - protein, 10 aa, Borrelia FIhF
KEIFHQFSPF

SEQ ID NO: 5051 - protein, 10 aa, Borrelia FIhF
IYEMKKVVSY

SEQ ID NO: 5052 - protein, 10 aa, Borrelia FIhF
YEMKKVVSYV

SEQ ID NO: 5053 - protein, 10 aa, Borrelia FIhF
AEPLTFIRRI

SEQ ID NO: 5054 - protein, 11 aa, Borrelia FIhF
SENYIKDINEF

SEQ ID NO: 5055 - protein, 12 aa, Borrelia FIhF
FSENYIKDINEF

SEQ ID NO: 5056 - protein, 12 aa, Borrelia FIhF
SENYIKDINEFI

SEQ ID NO: 5057 - protein, 12 aa, Borrelia FIhF
SLIYEMKKVVSY

SEQ ID NO: 5058 - protein, 12 aa, Borrelia FIhF
AEFIKKIKSKSY

SEQ ID NO: 5059 - protein, 9 aa, Borrelia FIhF
EENSSIEDV

SEQ ID NO: 5060 - protein, 9 aa, Borrelia FIhF
KENINHPTI

SEQ ID NO: 5061 - protein, 9 aa, Borrelia FIhF
REDVVLYIA

SEQ ID NO: 5062 - protein, 9 aa, Borrelia FIhF
AEMKELLNA

SEQ ID NO: 5063 - protein, 9 aa, Borrelia FIhF
AEFHLAVSS

SEQ ID NO: 5064 - protein, 10 aa, Borrelia FIhF
TEKGPTYNEV

SEQ ID NO: 5065 - protein, 10 aa, Borrelia FIhF
RENDFSENYI

SEQ ID NO: 5066 - protein, 10 aa, Borrelia FIhF
VREDVVLYIA

SEQ ID NO: 5067 - protein, 10 aa, Borrelia FIhF
REDVVLYIAK

SEQ ID NO: 5068 - protein, 10 aa, Borrelia FIhF
LAEMKELLNA

SEQ ID NO: 5069 - protein, 10 aa, Borrelia FIhF
AEMKELLNAC

SEQ ID NO: 5070 - protein, 10 aa, Borrelia FIhF
DAEFHLAVSS

SEQ ID NO: 5071 - protein, 10 aa, Borrelia FIhF
AEFHLAVSST

SEQ ID NO: 5072 - protein, 10 aa, Borrelia FIhF
YEMKKVVSYV

SEQ ID NO: 5073 - protein, 10 aa, Borrelia FIhF
AEPLTFIRRI

SEQ ID NO: 5074 - protein, 11 aa, Borrelia FIhF
KLAEMKELLNA

SEQ ID NO: 5075 - protein, 11 aa, Borrelia FIhF
LAEMKELLNAC

SEQ ID NO: 5076 - protein, 11 aa, Borrelia FIhF
AEMKELLNACG

SEQ ID NO: 5077 - protein, 11 aa, Borrelia FIhF
DAEFHLAVSST

SEQ ID NO: 5078 - protein, 11 aa, Borrelia FIhF
AEFHLAVSSTT

SEQ ID NO: 5079 - protein, 12 aa, Borrelia FIhF
MKLAEMKELLNA

SEQ ID NO: 5080 - protein, 12 aa, Borrelia FIhF
KLAEMKELLNAC

SEQ ID NO: 5081 - protein, 12 aa, Borrelia FIhF
LAEMKELLNACG

SEQ ID NO: 5082 - protein, 12 aa, Borrelia FIhF
AEMKELLNACGR

SEQ ID NO: 5083 - protein, 12 aa, Borrelia FIhF
RDAEFHLAVSST

SEQ ID NO: 5084 - protein, 12 aa, Borrelia FIhF
DAEFHLAVSSTT

SEQ ID NO: 5085 - protein, 9 aa, Borrelia FIhF
EPLTFIRRI

SEQ ID NO: 5086 - protein, 10 aa, Borrelia FihF
FSPFNYKTVI

SEQ ID NO: 5087 - protein, 9 aa, Borrelia FlaB
TVDANTSLA

SEQ ID NO: 5088 - protein, 9 aa, Borrelia FlaB
MTDEVVAAT

SEQ ID NO: 5089 - protein, 10 aa, Borrelia FlaB
KTQEKLSSGY

SEQ ID NO: 5090 - protein, 10 aa, Borrelia FlaB
YSANVANLFA

SEQ ID NO: 5091 - protein, 10 aa, Borrelia FlaB
TTVDANTSLA

SEQ ID NO: 5092 - protein, 11 aa, Borrelia FlaB
TTTVDANTSLA

SEQ ID NO: 5093 - protein, 12 aa, Borrelia FlaB
LSKTQEKLSSGY

SEQ ID NO: 5094 - protein, 12 aa, Borrelia FlaB
VTTTVDANTSLA

SEQ ID NO: 5095 - protein, 9 aa, Borrelia FlaB
MIINHNTSA

SEQ ID NO: 5096 - protein, 9 aa, Borrelia FlaB
QLTDEINRI

SEQ ID NO: 5097 - protein, 9 aa, Borrelia FlaB
AQYNQMHML

SEQ ID NO: 5098 - protein, 9 aa, Borrelia FlaB
SQASWTLRV

SEQ ID NO: 5099 - protein, 9 aa, Borrelia FlaB
AIAVNIYSA

SEQ ID NO: 5100 - protein, 9 aa, Borrelia FlaB
AVNIYSANV

SEQ ID NO: 5101 - protein, 9 aa, Borrelia FlaB
AQAAQAAPV

SEQ ID NO: 5102 - protein, 9 aa, Borrelia FlaB
TQGGVNSPV

SEQ ID NO: 5103 - protein, 9 aa, Borrelia FlaB
SLAKIENAI

SEQ ID NO: 5104 - protein, 9 aa, Borrelia FlaB
NLGAFQNRL

SEQ ID NO: 5105 - protein, 9 aa, Borrelia FlaB
TMTDEVVAA

SEQ ID NO: 5106 - protein, 9 aa, Borrelia FlaB
MTDEVVAAT

SEQ ID NO: 5107 - protein, 9 aa, Borrelia FlaB
SAMAMIAQA

SEQ ID NO: 5108 - protein, 9 aa, Borrelia FlaB
AMIAQANQV

SEQ ID NO: 5109 - protein, 9 aa, Borrelia FlaB
KINAQITGL

SEQ ID NO: 5110 - protein, 9 aa, Borrelia FlaB
AIAVNIYAA

SEQ ID NO: 5111 - protein, 9 aa, Borrelia FlaB
SQAAQTAPV

SEQ ID NO: 5112 - protein, 9 aa, Borrelia FlaB
SQGGVNSPV

SEQ ID NO: 5113 - protein, 9 aa, Borrelia FlaB
MTDEVVAST

SEQ ID NO: 5114 - protein, 9 aa, Borrelia FlaB
AQAAQTAPV

SEQ ID NO: 5115 - protein, 9 aa, Borrelia FlaB
AQTAQAAPV

SEQ ID NO: 5116 - protein, 9 aa, Borrelia FlaB
SIQIEIEQL

SEQ ID NO: 5117 - protein, 9 aa, Borrelia FlaB
NLNEVEKVL

SEQ ID NO: 5118 - protein, 10 aa, Borrelia FlaB
NLNEVEKVLV

SEQ ID NO: 5119 - protein, 10 aa, Borrelia FlaB
VLVRMKELAV

SEQ ID NO: 5120 - protein, 10 aa, Borrelia FlaB
GSQASWTLRV

SEQ ID NO: 5121 - protein, 10 aa, Borrelia FlaB
ILTQSAMAMI

SEQ ID NO: 5122 - protein, 10 aa, Borrelia FlaB
MAMIAQANQV

SEQ ID NO: 5123 - protein, 10 aa, Borrelia FlaB
AQANQVPQYV

SEQ ID NO: 5124 - protein, 10 aa, Borrelia FlaB
TVDANTSLAK

SEQ ID NO: 5125 - protein, 11 aa, Borrelia FlaB
SLSGSQASWTL

SEQ ID NO: 5126 - protein, 12 aa, Borrelia FlaB
IQIEIEQLTDEI

SEQ ID NO: 5127 - protein, 12 aa, Borrelia FlaB
RMISDQRANLGA

SEQ ID NO: 5128 - protein, 12 aa, Borrelia FlaB
AQIKDATMTDEV

SEQ ID NO: 5129 - protein, 9 aa, Borrelia FlaB
AINAANLSK

SEQ ID NO: 5130 - protein, 9 aa, Borrelia FlaB
AAGMGVSGK

SEQ ID NO: 5131 - protein, 9 aa, Borrelia FlaB
SQASRNTSK

SEQ ID NO: 5132 - protein, 9 aa, Borrelia FlaB
NQMHMLSNK

SEQ ID NO: 5133 - protein, 9 aa, Borrelia FlaB
SINAANLSK

SEQ ID NO: 5134 - protein, 9 aa, Borrelia FlaB
GINAANLSK

SEQ ID NO: 5135 - protein, 10 aa, Borrelia FlaB
NAINAANLSK

SEQ ID NO: 5136 - protein, 10 aa, Borrelia FlaB
AINAANLSKT

SEQ ID NO: 5137 - protein, 10 aa, Borrelia FlaB
KLSSGYRINR

SEQ ID NO: 5138 - protein, 10 aa, Borrelia FlaB
LSQASRNTSK

SEQ ID NO: 5139 - protein, 10 aa, Borrelia FlaB
YNQMHMLSNK

SEQ ID NO: 5140 - protein, 10 aa, Borrelia FlaB
TVDANTSLAK

SEQ ID NO: 5141 - protein, 10 aa, Borrelia FlaB
STEYAIENLK

SEQ ID NO: 5142 - protein, 10 aa, Borrelia FlaB
NLKASYAQIK

SEQ ID NO: 5143 - protein, 10 aa, Borrelia FlaB
VPQYVLSLLR

SEQ ID NO: 5144 - protein, 10 aa, Borrelia FlaB
NSINAANLSK

SEQ ID NO: 5145 - protein, 10 aa, Borrelia FlaB
SINAANLSKT

SEQ ID NO: 5146 - protein, 10 aa, Borrelia FlaB
NGINAANLSK

SEQ ID NO: 5147 - protein, 10 aa, Borrelia FlaB
GINAANLSKT

SEQ ID NO: 5148 - protein, 11 aa, Borrelia FlaB
GLSQASRNTSK

SEQ ID NO: 5149 - protein, 11 aa, Borrelia FlaB
TTVDANTSLAK

SEQ ID NO: 5150 - protein, 12 aa, Borrelia FlaB
RNNAINAANLSK

SEQ ID NO: 5151 - protein, 12 aa, Borrelia FlaB
AQYNQMHMLSNK

SEQ ID NO: 5152 - protein, 12 aa, Borrelia FlaB
MLSNKSASQNVK

SEQ ID NO: 5153 - protein, 12 aa, Borrelia FlaB
KTAEELGMQPAK

SEQ ID NO: 5154 - protein, 12 aa, Borrelia FlaB
TTTVDANTSLAK

SEQ ID NO: 5155 - protein, 12 aa, Borrelia FlaB
RNNSINAANLSK

SEQ ID NO: 5156 - protein, 12 aa, Borrelia FlaB
RTAEELGMQPAK

SEQ ID NO: 5157 - protein, 12 aa, Borrelia FlaB
RNNGINAANLSK

SEQ ID NO: 5158 - protein, 9 aa, Borrelia FlaB
NTSAINASR

SEQ ID NO: 5159 - protein, 9 aa, Borrelia FlaB
AINAANLSK

SEQ ID NO: 5160 - protein, 9 aa, Borrelia FlaB
LSSGYRINR

SEQ ID NO: 5161 - protein, 9 aa, Borrelia FlaB
AAGMGVSGK

SEQ ID NO: 5162 - protein, 9 aa, Borrelia FlaB
SQASRNTSK

SEQ ID NO: 5163 - protein, 9 aa, Borrelia FlaB
NQMHMLSNK

SEQ ID NO: 5164 - protein, 9 aa, Borrelia FlaB
GSQASWTLR

SEQ ID NO: 5165 - protein, 9 aa, Borrelia FlaB
SINAANLSK

SEQ ID NO: 5166 - protein, 9 aa, Borrelia FlaB
GINAANLSK

SEQ ID NO: 5167 - protein, 10 aa, Borrelia FlaB
HNTSAINASR

SEQ ID NO: 5168 - protein, 10 aa, Borrelia FlaB
NAINAANLSK

SEQ ID NO: 5169 - protein, 10 aa, Borrelia FlaB
AINAANLSKT

SEQ ID NO: 5170 - protein, 10 aa, Borrelia FlaB
AANLSKTQEK

SEQ ID NO: 5171 - protein, 10 aa, Borrelia FlaB
KLSSGYRINR

SEQ ID NO: 5172 - protein, 10 aa, Borrelia FlaB
LSQASRNTSK

SEQ ID NO: 5173 - protein, 10 aa, Borrelia FlaB
YNQMHMLSNK

SEQ ID NO: 5174 - protein, 10 aa, Borrelia FlaB
SGSQASWTLR

SEQ ID NO: 5175 - protein, 10 aa, Borrelia FlaB
TVDANTSLAK

SEQ ID NO: 5176 - protein, 10 aa, Borrelia FlaB
STEYAIENLK

SEQ ID NO: 5177 - protein, 10 aa, Borrelia FlaB
VPQYVLSLLR

SEQ ID NO: 5178 - protein, 10 aa, Borrelia FlaB
NSINAANLSK

SEQ ID NO: 5179 - protein, 10 aa, Borrelia FlaB
SINAANLSKT

SEQ ID NO: 5180 - protein, 10 aa, Borrelia FlaB
NGINAANLSK

SEQ ID NO: 5181 - protein, 10 aa, Borrelia FlaB
GINAANLSKT

SEQ ID NO: 5182 - protein, 11 aa, Borrelia FlaB
NNAINAANLSK

SEQ ID NO: 5183 - protein, 11 aa, Borrelia FlaB
TTEGNLNEVEK

SEQ ID NO: 5184 - protein, 11 aa, Borrelia FlaB
TTVDANTSLAK

SEQ ID NO: 5185 - protein, 11 aa, Borrelia FlaB
NSTEYAIENLK

SEQ ID NO: 5186 - protein, 11 aa, Borrelia FlaB
STEYAIENLKA

SEQ ID NO: 5187 - protein, 11 aa, Borrelia FlaB
NNSINAANLSK

SEQ ID NO: 5188 - protein, 11 aa, Borrelia FlaB
DSTEYAIENLK

SEQ ID NO: 5189 - protein, 12 aa, Borrelia FlaB
RNNAINAANLSK

SEQ ID NO: 5190 - protein, 12 aa, Borrelia FlaB
AQYNQMHMLSNK

SEQ ID NO: 5191 - protein, 12 aa, Borrelia FlaB
KTAEELGMQPAK

SEQ ID NO: 5192 - protein, 12 aa, Borrelia FlaB
TTTVDANTSLAK

SEQ ID NO: 5193 - protein, 12 aa, Borrelia FlaB
TTVDANTSLAKI

SEQ ID NO: 5194 - protein, 12 aa, Borrelia FlaB
KNSTEYAIENLK

SEQ ID NO: 5195 - protein, 12 aa, Borrelia FlaB
NSTEYAIENLKA

SEQ ID NO: 5196 - protein, 12 aa, Borrelia FlaB
RNNSINAANLSK

SEQ ID NO: 5197 - protein, 12 aa, Borrelia FlaB
RTAEELGMQPAK

SEQ ID NO: 5198 - protein, 12 aa, Borrelia FlaB
KDSTEYAIENLK

SEQ ID NO: 5199 - protein, 12 aa, Borrelia FlaB
DSTEYAIENLKA

SEQ ID NO: 5200 - protein, 12 aa, Borrelia FlaB
RNNGINAANLSK

SEQ ID NO: 5201 - protein, 9 aa, Borrelia FlaB
IYSANVANL

SEQ ID NO: 5202 - protein, 9 aa, Borrelia FlaB
YSANVANLF

SEQ ID NO: 5203 - protein, 9 aa, Borrelia FlaB
IYAANVANL

SEQ ID NO: 5204 - protein, 9 aa, Borrelia FlaB
YAANVANLF

SEQ ID NO: 5205 - protein, 10 aa, Borrelia FlaB
NIYSANVANL

SEQ ID NO: 5206 - protein, 10 aa, Borrelia FlaB
IYSANVANLF

SEQ ID NO: 5207 - protein, 10 aa, Borrelia FlaB
NIYAANVANL

SEQ ID NO: 5208 - protein, 10 aa, Borrelia FlaB
IYAANVANLF

SEQ ID NO: 5209 - protein, 11 aa, Borrelia FlaB
NIYSANVANLF

SEQ ID NO: 5210 - protein, 11 aa, Borrelia FlaB
IYSANVANLFA

SEQ ID NO: 5211 - protein, 11 aa, Borrelia FlaB
NIYAANVANLF

SEQ ID NO: 5212 - protein, 11 aa, Borrelia FlaB
IYAANVANLFS

SEQ ID NO: 5213 - protein, 12 aa, Borrelia FlaB
VNIYSANVANLF

SEQ ID NO: 5214 - protein, 12 aa, Borrelia FlaB
NIYSANVANLFA

SEQ ID NO: 5215 - protein, 12 aa, Borrelia FlaB
IYSANVANLFAG

SEQ ID NO: 5216 - protein, 12 aa, Borrelia FlaB
VNIYAANVANLF

SEQ ID NO: 5217 - protein, 12 aa, Borrelia FlaB
NIYAANVANLFS

SEQ ID NO: 5218 - protein, 12 aa, Borrelia FlaB
IYAANVANLFSG

SEQ ID NO: 5219 - protein, 9 aa, Borrelia FlaB
ESIKNSTEY

SEQ ID NO: 5220 - protein, 9 aa, Borrelia FlaB
ESIKDSTEY

SEQ ID NO: 5221 - protein, 9 aa, Borrelia FlaB
YSANVANLF

SEQ ID NO: 5222 - protein, 9 aa, Borrelia FlaB
ESIKNSTEY

SEQ ID NO: 5223 - protein, 9 aa, Borrelia FlaB
YAANVANLF

SEQ ID NO: 5224 - protein, 9 aa, Borrelia FlaB
ESIKDSTEY

SEQ ID NO: 5225 - protein, 10 aa, Borrelia FlaB
ESIKNSTEYA

SEQ ID NO: 5226 - protein, 10 aa, Borrelia FlaB
YAIENLKASY

SEQ ID NO: 5227 - protein, 11 aa, Borrelia FlaB
EYAIENLKASY

SEQ ID NO: 5228 - protein, 11 aa, Borrelia FlaB
YAIENLKASYA

SEQ ID NO: 5229 - protein, 12 aa, Borrelia FlaB
YAIENLKASYAQ

SEQ ID NO: 5230 - protein, 9 aa, Borrelia FlaB
AVQSGNGTY

SEQ ID NO: 5231 - protein, 9 aa, Borrelia FlaB
YSANVANLF

SEQ ID NO: 5232 - protein, 9 aa, Borrelia FlaB
YAANVANLF

SEQ ID NO: 5233 - protein, 10 aa, Borrelia FlaB
INRIADQAQY

SEQ ID NO: 5234 - protein, 10 aa, Borrelia FlaB
IYSANVANLF

SEQ ID NO: 5235 - protein, 10 aa, Borrelia FlaB
YAIENLKASY

SEQ ID NO: 5236 - protein, 10 aa, Borrelia FlaB
IYAANVANLF

SEQ ID NO: 5237 - protein, 12 aa, Borrelia FlaB
AMIAQANQVPQY

SEQ ID NO: 5238 - protein, 9 aa, Borrelia FlaB
NTSAINASR

SEQ ID NO: 5239 - protein, 9 aa, Borrelia FlaB
LSSGYRINR

SEQ ID NO: 5240 - protein, 9 aa, Borrelia FlaB
NQMHMLSNK

SEQ ID NO: 5241 - protein, 9 aa, Borrelia FlaB
GSQASWTLR

SEQ ID NO: 5242 - protein, 9 aa, Borrelia FlaB
ASWTLRVHV

SEQ ID NO: 5243 - protein, 9 aa, Borrelia FlaB
LAKIENAIR

SEQ ID NO: 5244 - protein, 9 aa, Borrelia FlaB
AIRMISDQR

SEQ ID NO: 5245 - protein, 9 aa, Borrelia FlaB
ANLGAFQNR

SEQ ID NO: 5246 - protein, 9 aa, Borrelia FlaB
ITGLSQASR

SEQ ID NO: 5247 - protein, 10 aa, Borrelia FlaB
HNTSAINASR

SEQ ID NO: 5248 - protein, 10 aa, Borrelia FlaB
TQEKLSSGYR

SEQ ID NO: 5249 - protein, 10 aa, Borrelia FlaB
KLSSGYRINR

SEQ ID NO: 5250 - protein, 10 aa, Borrelia FlaB
VSGKINAQIR

SEQ ID NO: 5251 - protein, 10 aa, Borrelia FlaB
QIRGLSQASR

SEQ ID NO: 5252 - protein, 10 aa, Borrelia FlaB
SGSQASWTLR

SEQ ID NO: 5253 - protein, 10 aa, Borrelia FlaB
GSQASWTLRV

SEQ ID NO: 5254 - protein, 10 aa, Borrelia FlaB
SLAKIENAIR

SEQ ID NO: 5255 - protein, 10 aa, Borrelia FlaB
NAIRMISDQR

SEQ ID NO: 5256 - protein, 10 aa, Borrelia FlaB
RANLGAFQNR

SEQ ID NO: 5257 - protein, 10 aa, Borrelia FlaB
STEYAIENLK

SEQ ID NO: 5258 - protein, 10 aa, Borrelia FlaB
VPQYVLSLLR

SEQ ID NO: 5259 - protein, 11 aa, Borrelia FlaB
NHNTSAINASR

SEQ ID NO: 5260 - protein, 11 aa, Borrelia FlaB
KTQEKLSSGYR

SEQ ID NO: 5261 - protein, 11 aa, Borrelia FlaB
EKLSSGYRINR

SEQ ID NO: 5262 - protein, 11 aa, Borrelia FlaB
LSGSQASWTLR

SEQ ID NO: 5263 - protein, 11 aa, Borrelia FlaB
QRANLGAFQNR

SEQ ID NO: 5264 - protein, 12 aa, Borrelia FlaB
INHNTSAINASR

SEQ ID NO: 5265 - protein, 12 aa, Borrelia FlaB
SKTQEKLSSGYR

SEQ ID NO: 5266 - protein, 12 aa, Borrelia FlaB
KTQEKLSSGYRI

SEQ ID NO: 5267 - protein, 12 aa, Borrelia FlaB
QEKLSSGYRINR

SEQ ID NO: 5268 - protein, 12 aa, Borrelia FlaB
SLSGSQASWTLR

SEQ ID NO: 5269 - protein, 12 aa, Borrelia FlaB
DQRANLGAFQNR

SEQ ID NO: 5270 - protein, 9 aa, Borrelia FlaB
IINHNTSAI

SEQ ID NO: 5271 - protein, 9 aa, Borrelia FlaB
KINAQIRGL

SEQ ID NO: 5272 - protein, 9 aa, Borrelia FlaB
SLAKIENAI

SEQ ID NO: 5273 - protein, 9 aa, Borrelia FlaB
KIENAIRMI

SEQ ID NO: 5274 - protein, 9 aa, Borrelia FlaB
VVAATTNSI

SEQ ID NO: 5275 - protein, 9 aa, Borrelia FlaB
KINAQITGL

SEQ ID NO: 5276 - protein, 9 aa, Borrelia FlaB
VVASTTNSI

SEQ ID NO: 5277 - protein, 10 aa, Borrelia FlaB
MIINHNTSAI

SEQ ID NO: 5278 - protein, 9 aa, Borrelia FlaB
NTSAINASR

SEQ ID NO: 5279 - protein, 9 aa, Borrelia FlaB
LSSGYRINR

SEQ ID NO: 5280 - protein, 9 aa, Borrelia FlaB
NGTYSDSDR

SEQ ID NO: 5281 - protein, 9 aa, Borrelia FlaB
NQMHMLSNK

SEQ ID NO: 5282 - protein, 9 aa, Borrelia FlaB
GSQASWTLR

SEQ ID NO: 5283 - protein, 9 aa, Borrelia FlaB
EAIAVNIYS

SEQ ID NO: 5284 - protein, 9 aa, Borrelia FlaB
YSANVANLF

SEQ ID NO: 5285 - protein, 9 aa, Borrelia FlaB
LAKIENAIR

SEQ ID NO: 5286 - protein, 9 aa, Borrelia FlaB
AIRMISDQR

SEQ ID NO: 5287 - protein, 9 aa, Borrelia FlaB
ESIKNSTEY

SEQ ID NO: 5288 - protein, 9 aa, Borrelia FlaB
TEYAIENLK

SEQ ID NO: 5289 - protein, 9 aa, Borrelia FlaB
ITGLSQASR

SEQ ID NO: 5290 - protein, 9 aa, Borrelia FlaB
NGTYSDADR

SEQ ID NO: 5291 - protein, 9 aa, Borrelia FlaB
SINAANLSK

SEQ ID NO: 5292 - protein, 9 aa, Borrelia FlaB
EAIAVNIYA

SEQ ID NO: 5293 - protein, 9 aa, Borrelia FlaB
YAANVANLF

SEQ ID NO: 5294 - protein, 9 aa, Borrelia FlaB
ESIKDSTEY

SEQ ID NO: 5295 - protein, 10 aa, Borrelia FlaB
HNTSAINASR

SEQ ID NO: 5296 - protein, 10 aa, Borrelia FlaB
NTSAINASRN

SEQ ID NO: 5297 - protein, 10 aa, Borrelia FlaB
NAINAANLSK

SEQ ID NO: 5298 - protein, 10 aa, Borrelia FlaB
KLSSGYRINR

SEQ ID NO: 5299 - protein, 10 aa, Borrelia FlaB
DAAGMGVSGK

SEQ ID NO: 5300 - protein, 10 aa, Borrelia FlaB
LSQASRNTSK

SEQ ID NO: 5301 - protein, 10 aa, Borrelia FlaB
EVEKVLVRMK

SEQ ID NO: 5302 - protein, 10 aa, Borrelia FlaB
YNQMHMLSNK

SEQ ID NO: 5303 - protein, 10 aa, Borrelia FlaB
SGSQASWTLR

SEQ ID NO: 5304 - protein, 10 aa, Borrelia FlaB
TVDANTSLAK

SEQ ID NO: 5305 - protein, 10 aa, Borrelia FlaB
SLAKIENAIR

SEQ ID NO: 5306 - protein, 10 aa, Borrelia FlaB
NAIRMISDQR

SEQ ID NO: 5307 - protein, 10 aa, Borrelia FlaB
STEYAIENLK

SEQ ID NO: 5308 - protein, 10 aa, Borrelia FlaB
YAIENLKASY

SEQ ID NO: 5309 - protein, 10 aa, Borrelia FlaB
NLKASYAQIK

SEQ ID NO: 5310 - protein, 10 aa, Borrelia FlaB
QITGLSQASR

SEQ ID NO: 5311 - protein, 10 aa, Borrelia FlaB
NSINAANLSK

SEQ ID NO: 5312 - protein, 10 aa, Borrelia FlaB
NGINAANLSK

SEQ ID NO: 5313 - protein, 11 aa, Borrelia FlaB
NHNTSAINASR

SEQ ID NO: 5314 - protein, 11 aa, Borrelia FlaB
HNTSAINASRN

SEQ ID NO: 5315 - protein, 11 aa, Borrelia FlaB
TTVDANTSLAK

SEQ ID NO: 5316 - protein, 11 aa, Borrelia FlaB
ENAIRMISDQR

SEQ ID NO: 5317 - protein, 11 aa, Borrelia FlaB
NSTEYAIENLK

SEQ ID NO: 5318 - protein, 11 aa, Borrelia FlaB
DSTEYAIENLK

SEQ ID NO: 5319 - protein, 12 aa, Borrelia FlaB
INHNTSAINASR

SEQ ID NO: 5320 - protein, 12 aa, Borrelia FlaB
NHNTSAINASRN

SEQ ID NO: 5321 - protein, 12 aa, Borrelia FlaB
TTTVDANTSLAK

SEQ ID NO: 5322 - protein, 12 aa, Borrelia FlaB
NTSLAKIENAIR

SEQ ID NO: 5323 - protein, 12 aa, Borrelia FlaB
IENAIRMISDQR

SEQ ID NO: 5324 - protein, 12 aa, Borrelia FlaB
KNSTEYAIENLK

SEQ ID NO: 5325 - protein, 12 aa, Borrelia FlaB
KDSTEYAIENLK

SEQ ID NO: 5326 - protein, 9 aa, Borrelia FlaB
LVRMKELAV

SEQ ID NO: 5327 - protein, 9 aa, Borrelia FlaB
QPAKINTPA

SEQ ID NO: 5328 - protein, 9 aa, Borrelia FlaB
TPASLSGSQ

SEQ ID NO: 5329 - protein, 9 aa, Borrelia FlaB
QPTPATAPT

SEQ ID NO: 5330 - protein, 9 aa, Borrelia FlaB
SPVNVTTTV

SEQ ID NO: 5331 - protein, 9 aa, Borrelia FlaB
VVAATTNSI

SEQ ID NO: 5332 - protein, 9 aa, Borrelia FlaB
VPQYVLSLL

SEQ ID NO: 5333 - protein, 9 aa, Borrelia FlaB
QPAPATAPS

SEQ ID NO: 5334 - protein, 9 aa, Borrelia FlaB
VVASTTNSI

SEQ ID NO: 5335 - protein, 10 aa, Borrelia FlaB
MQPAKINTPA

SEQ ID NO: 5336 - protein, 10 aa, Borrelia FlaB
TPASLSGSQA

SEQ ID NO: 5337 - protein, 10 aa, Borrelia FlaB
QQPTPATAPT

SEQ ID NO: 5338 - protein, 10 aa, Borrelia FlaB
NSPVNVTTTV

SEQ ID NO: 5339 - protein, 10 aa, Borrelia FlaB
SPVNVTTTVD

SEQ ID NO: 5340 - protein, 10 aa, Borrelia FlaB
QVPQYVLSLL

SEQ ID NO: 5341 - protein, 10 aa, Borrelia FlaB
QPAPATAPSQ

SEQ ID NO: 5342 - protein, 11 aa, Borrelia FlaB
QPAKINTPASL

SEQ ID NO: 5343 - protein, 11 aa, Borrelia FlaB
APTQGGVNSPV

SEQ ID NO: 5344 - protein, 11 aa, Borrelia FlaB
APSQGGVNSPV

SEQ ID NO: 5345 - protein, 12 aa, Borrelia FlaB
MQPAKINTPASL

SEQ ID NO: 5346 - protein, 12 aa, Borrelia FlaB
QPAKINTPASLS

SEQ ID NO: 5347 - protein, 12 aa, Borrelia FlaB
TAPTQGGVNSPV

SEQ ID NO: 5348 - protein, 12 aa, Borrelia FlaB
APTQGGVNSPVN

SEQ ID NO: 5349 - protein, 12 aa, Borrelia FlaB
TAPSQGGVNSPV

SEQ ID NO: 5350 - protein, 12 aa, Borrelia FlaB
APSQGGVNSPVN

SEQ ID NO: 5351 - protein, 9 aa, Borrelia FlaB
MIINHNTSA

SEQ ID NO: 5352 - protein, 9 aa, Borrelia FlaB
LVRMKELAV

SEQ ID NO: 5353 - protein, 9 aa, Borrelia FlaB
NLKASYAQI

SEQ ID NO: 5354 - protein, 9 aa, Borrelia FlaB
YAQIKDATM

SEQ ID NO: 5355 - protein, 10 aa, Borrelia FlaB
MIINHNTSAI

SEQ ID NO: 5356 - protein, 10 aa, Borrelia FlaB
VLVRMKELAV

SEQ ID NO: 5357 - protein, 10 aa, Borrelia FlaB
SYAQIKDATM

SEQ ID NO: 5358 - protein, 9 aa, Borrelia FlaB
IINHNTSAI

SEQ ID NO: 5359 - protein, 9 aa, Borrelia FlaB
TQEKLSSGY

SEQ ID NO: 5360 - protein, 9 aa, Borrelia FlaB
EKLSSGYRI

SEQ ID NO: 5361 - protein, 9 aa, Borrelia FlaB
RASDDAAGM

SEQ ID NO: 5362 - protein, 9 aa, Borrelia FlaB
AQIRGLSQA

SEQ ID NO: 5363 - protein, 9 aa, Borrelia FlaB
ASRNTSKAI

SEQ ID NO: 5364 - protein, 9 aa, Borrelia FlaB
RNTSKAINF

SEQ ID NO: 5365 - protein, 9 aa, Borrelia FlaB
KAINFIQTT

SEQ ID NO: 5366 - protein, 9 aa, Borrelia FlaB
RMKELAVQS

SEQ ID NO: 5367 - protein, 9 aa, Borrelia FlaB
NRIADQAQY

SEQ ID NO: 5368 - protein, 9 aa, Borrelia FlaB
QAQYNQMHM

SEQ ID NO: 5369 - protein, 9 aa, Borrelia FlaB
AQYNQMHML

SEQ ID NO: 5370 - protein, 9 aa, Borrelia FlaB
QMHMLSNKS

SEQ ID NO: 5371 - protein, 9 aa, Borrelia FlaB
AKINTPASL

SEQ ID NO: 5372 - protein, 9 aa, Borrelia FlaB
SQASWTLRV

SEQ ID NO: 5373 - protein, 9 aa, Borrelia FlaB
YSANVANLF

SEQ ID NO: 5374 - protein, 9 aa, Borrelia FlaB
AQAAQAAPV

SEQ ID NO: 5375 - protein, 9 aa, Borrelia FlaB
AQAAPVQEG

SEQ ID NO: 5376 - protein, 9 aa, Borrelia FlaB
AQQPTPATA

SEQ ID NO: 5377 - protein, 9 aa, Borrelia FlaB
AKIENAIRM

SEQ ID NO: 5378 - protein, 9 aa, Borrelia FlaB
RMISDQRAN

SEQ ID NO: 5379 - protein, 9 aa, Borrelia FlaB
DQRANLGAF

SEQ ID NO: 5380 - protein, 9 aa, Borrelia FlaB
ESIKNSTEY

SEQ ID NO: 5381 - protein, 9 aa, Borrelia FlaB
IKNSTEYAI

SEQ ID NO: 5382 - protein, 9 aa, Borrelia FlaB
NLKASYAQI

SEQ ID NO: 5383 - protein, 9 aa, Borrelia FlaB
LKASYAQIK

SEQ ID NO: 5384 - protein, 9 aa, Borrelia FlaB
YAQIKDATM

SEQ ID NO: 5385 - protein, 9 aa, Borrelia FlaB
AQIKDATMT

SEQ ID NO: 5386 - protein, 9 aa, Borrelia FlaB
VAATTNSIL

SEQ ID NO: 5387 - protein, 9 aa, Borrelia FlaB
NSILTQSAM

SEQ ID NO: 5388 - protein, 9 aa, Borrelia FlaB
ILTQSAMAM

SEQ ID NO: 5389 - protein, 9 aa, Borrelia FlaB
TQSAMAMIA

SEQ ID NO: 5390 - protein, 9 aa, Borrelia FlaB
AMAMIAQAN

SEQ ID NO: 5391 - protein, 9 aa, Borrelia FlaB
AMIAQANQV

SEQ ID NO: 5392 - protein, 9 aa, Borrelia FlaB
AQANQVPQY

SEQ ID NO: 5393 - protein, 9 aa, Borrelia FlaB
AQITGLSQA

SEQ ID NO: 5394 - protein, 9 aa, Borrelia FlaB
YAANVANLF

SEQ ID NO: 5395 - protein, 9 aa, Borrelia FlaB
SQAAQTAPV

SEQ ID NO: 5396 - protein, 9 aa, Borrelia FlaB
AQTAPVQEG

SEQ ID NO: 5397 - protein, 9 aa, Borrelia FlaB
AQQPAPATA

SEQ ID NO: 5398 - protein, 9 aa, Borrelia FlaB
ESIKDSTEY

SEQ ID NO: 5399 - protein, 9 aa, Borrelia FlaB
IKDSTEYAI

SEQ ID NO: 5400 - protein, 9 aa, Borrelia FlaB
VASTTNSIL

SEQ ID NO: 5401 - protein, 9 aa, Borrelia FlaB
AQAAQTAPV

SEQ ID NO: 5402 - protein, 9 aa, Borrelia FlaB
AQTAQAAPV

SEQ ID NO: 5403 - protein, 10 aa, Borrelia FlaB
SDQRANLGAF

SEQ ID NO: 5404 - protein, 10 aa, Borrelia FlaB
IAQANQVPQY

SEQ ID NO: 5405 - protein, 9 aa, Borrelia FlaB
DEAIAVNIY

SEQ ID NO: 5406 - protein, 9 aa, Borrelia FlaB
IENAIRMIS

SEQ ID NO: 5407 - protein, 9 aa, Borrelia FlaB
DQRANLGAF

SEQ ID NO: 5408 - protein, 9 aa, Borrelia FlaB
DEVVAATTN

SEQ ID NO: 5409 - protein, 9 aa, Borrelia FlaB
DEVVASTTN

SEQ ID NO: 5410 - protein, 10 aa, Borrelia FlaB
NEVEKVLVRM

SEQ ID NO: 5411 - protein, 10 aa, Borrelia FlaB
QDEAIAVNIY

SEQ ID NO: 5412 - protein, 10 aa, Borrelia FlaB
DEAIAVNIYS

SEQ ID NO: 5413 - protein, 10 aa, Borrelia FlaB
DEAIAVNIYA

SEQ ID NO: 5414 - protein, 11 aa, Borrelia FlaB
NQDEAIAVNIY

SEQ ID NO: 5415 - protein, 11 aa, Borrelia FlaB
DEAIAVNIYSA

SEQ ID NO: 5416 - protein, 11 aa, Borrelia FlaB
DEAIAVNIYAA

SEQ ID NO: 5417 - protein, 12 aa, Borrelia FlaB
ANQDEAIAVNIY

SEQ ID NO: 5418 - protein, 12 aa, Borrelia FlaB
NQDEAIAVNIYS

SEQ ID NO: 5419 - protein, 12 aa, Borrelia FlaB
TEYAIENLKASY

SEQ ID NO: 5420 - protein, 12 aa, Borrelia FlaB
NQDEAIAVNIYA

SEQ ID NO: 5421 - protein, 9 aa, Borrelia FlaB
RASDDAAGM

SEQ ID NO: 5422 - protein, 9 aa, Borrelia FlaB
AVQSGNGTY

SEQ ID NO: 5423 - protein, 9 aa, Borrelia FlaB
QPAKINTPA

SEQ ID NO: 5424 - protein, 9 aa, Borrelia FlaB
TPASLSGSQ

SEQ ID NO: 5425 - protein, 9 aa, Borrelia FlaB
IAVNIYSAN

SEQ ID NO: 5426 - protein, 9 aa, Borrelia FlaB
YSANVANLF

SEQ ID NO: 5427 - protein, 9 aa, Borrelia FlaB
FAGEGAQAA

SEQ ID NO: 5428 - protein, 9 aa, Borrelia FlaB
QPTPATAPT

SEQ ID NO: 5429 - protein, 9 aa, Borrelia FlaB
SPVNVTTTV

SEQ ID NO: 5430 - protein, 9 aa, Borrelia FlaB
ESIKNSTEY

SEQ ID NO: 5431 - protein, 9 aa, Borrelia FlaB
YAIENLKAS

SEQ ID NO: 5432 - protein, 9 aa, Borrelia FlaB
YAQIKDATM

SEQ ID NO: 5433 - protein, 9 aa, Borrelia FlaB
NSILTQSAM

SEQ ID NO: 5434 - protein, 9 aa, Borrelia FlaB
ILTQSAMAM

SEQ ID NO: 5435 - protein, 9 aa, Borrelia FlaB
IAVNIYAAN

SEQ ID NO: 5436 - protein, 9 aa, Borrelia FlaB
YAANVANLF

SEQ ID NO: 5437 - protein, 9 aa, Borrelia FlaB
FSGEGSQAA

SEQ ID NO: 5438 - protein, 9 aa, Borrelia FlaB
QPAPATAPS

SEQ ID NO: 5439 - protein, 9 aa, Borrelia FlaB
ESIKDSTEY

SEQ ID NO: 5440 - protein, 10 aa, Borrelia FlaB
LAVQSGNGTY

SEQ ID NO: 5441 - protein, 10 aa, Borrelia FlaB
MQPAKINTPA

SEQ ID NO: 5442 - protein, 10 aa, Borrelia FlaB
YAIENLKASY

SEQ ID NO: 5443 - protein, 10 aa, Borrelia FlaB
IAQANQVPQY

SEQ ID NO: 5444 - protein, 9 aa, Borrelia FlaB
AQYNQMHML

SEQ ID NO: 5445 - protein, 9 aa, Borrelia FlaB
AEELGMQPA

SEQ ID NO: 5446 - protein, 9 aa, Borrelia FlaB
GEGAQAAQA

SEQ ID NO: 5447 - protein, 9 aa, Borrelia FlaB
IENLKASYA

SEQ ID NO: 5448 - protein, 9 aa, Borrelia FlaB
KDATMTDEV

SEQ ID NO: 5449 - protein, 9 aa, Borrelia FlaB
GEGAQTAQA

SEQ ID NO: 5450 - protein, 10 aa, Borrelia FlaB
QEKLSSGYRI

SEQ ID NO: 5451 - protein, 10 aa, Borrelia FlaB
IEIEQLTDEI

SEQ ID NO: 5452 - protein, 10 aa, Borrelia FlaB
AEELGMQPAK

SEQ ID NO: 5453 - protein, 10 aa, Borrelia FlaB
EELGMQPAKI

SEQ ID NO: 5454 - protein, 10 aa, Borrelia FlaB
TEYAIENLKA

SEQ ID NO: 5455 - protein, 10 aa, Borrelia FlaB
AIENLKASYA

SEQ ID NO: 5456 - protein, 10 aa, Borrelia FlaB
QEGAQQPAPA

SEQ ID NO: 5457 - protein, 10 aa, Borrelia FlaB
QEKLSSGYRI

SEQ ID NO: 5458 - protein, 10 aa, Borrelia FlaB
EELGMQPAKI

SEQ ID NO: 5459 - protein, 10 aa, Borrelia FlaB
QDEAIAVNIY

SEQ ID NO: 5460 - protein, 10 aa, Borrelia FlaB
LESIKNSTEY

SEQ ID NO: 5461 - protein, 10 aa, Borrelia FlaB
AIENLKASYA

SEQ ID NO: 5462 - protein, 10 aa, Borrelia FlaB
LESIKDSTEY

SEQ ID NO: 5463 - protein, 12 aa, Borrelia FlaB
KELAVQSGNGTY

SEQ ID NO: 5464 - protein, 12 aa, Borrelia FlaB
TEYAIENLKASY

SEQ ID NO: 5465 - protein, 9 aa, Borrelia FlaB
AEELGMQPA

SEQ ID NO: 5466 - protein, 9 aa, Borrelia FlaB
GEGAQAAQA

SEQ ID NO: 5467 - protein, 9 aa, Borrelia FlaB
QEGAQEEGA

SEQ ID NO: 5468 - protein, 9 aa, Borrelia FlaB
QEEGAQQPT

SEQ ID NO: 5469 - protein, 9 aa, Borrelia FlaB
AQQPTPATA

SEQ ID NO: 5470 - protein, 9 aa, Borrelia FlaB
IENLKASYA

SEQ ID NO: 5471 - protein, 9 aa, Borrelia FlaB
QEGAQQEGA

SEQ ID NO: 5472 - protein, 9 aa, Borrelia FlaB
AQQPAPATA

SEQ ID NO: 5473 - protein, 9 aa, Borrelia FlaB
GEGAQTAQA

SEQ ID NO: 5474 - protein, 9 aa, Borrelia FlaB
QEGVQQEGA

SEQ ID NO: 5475 - protein, 10 aa, Borrelia FlaB
TAEELGMQPA

SEQ ID NO: 5476 - protein, 10 aa, Borrelia FlaB
AEELGMQPAK

SEQ ID NO: 5477 - protein, 10 aa, Borrelia FlaB
AGEGAQAAQA

SEQ ID NO: 5478 - protein, 10 aa, Borrelia FlaB
GEGAQAAQAA

SEQ ID NO: 5479 - protein, 10 aa, Borrelia FlaB
AQEEGAQQPT

SEQ ID NO: 5480 - protein, 10 aa, Borrelia FlaB
EEGAQQPTPA

SEQ ID NO: 5481 - protein, 10 aa, Borrelia FlaB
TEYAIENLKA

SEQ ID NO: 5482 - protein, 10 aa, Borrelia FlaB
AIENLKASYA

SEQ ID NO: 5483 - protein, 10 aa, Borrelia FlaB
DEAIAVNIYA

SEQ ID NO: 5484 - protein, 10 aa, Borrelia FlaB
GEGSQAAQTA

SEQ ID NO: 5485 - protein, 10 aa, Borrelia FlaB
QEGAQQPAPA

SEQ ID NO: 5486 - protein, 10 aa, Borrelia FlaB
GEGAQAAQTA

SEQ ID NO: 5487 - protein, 10 aa, Borrelia FlaB
SGEGAQTAQA

SEQ ID NO: 5488 - protein, 10 aa, Borrelia FlaB
GEGAQTAQAA

SEQ ID NO: 5489 - protein, 11 aa, Borrelia FlaB
KTAEELGMQPA

SEQ ID NO: 5490 - protein, 11 aa, Borrelia FlaB
TAEELGMQPAK

SEQ ID NO: 5491 - protein, 11 aa, Borrelia FlaB
AEELGMQPAKI

SEQ ID NO: 5492 - protein, 11 aa, Borrelia FlaB
FAGEGAQAAQA

SEQ ID NO: 5493 - protein, 11 aa, Borrelia FlaB
YAIENLKASYA

SEQ ID NO: 5494 - protein, 11 aa, Borrelia FlaB
RTAEELGMQPA

SEQ ID NO: 5495 - protein, 12 aa, Borrelia FlaB
VKTAEELGMQPA

SEQ ID NO: 5496 - protein, 12 aa, Borrelia FlaB
AEELGMQPAKIN

SEQ ID NO: 5497 - protein, 12 aa, Borrelia FlaB
LFAGEGAQAAQA

SEQ ID NO: 5498 - protein, 12 aa, Borrelia FlaB
EYAIENLKASYA

SEQ ID NO: 5499 - protein, 12 aa, Borrelia FlaB
VRTAEELGMQPA

SEQ ID NO: 5500 - protein, 12 aa, Borrelia FlaB
QEGAQQPAPATA

SEQ ID NO: 5501 - protein, 10 aa, Borrelia FlaB
MAMIAQANQV

SEQ ID NO: 5502 - protein, 10 aa, Borrelia P37-42
NLDEFAQEEY

SEQ ID NO: 5503 - protein, 11 aa, Borrelia P37-42
ANLDEFAQEEY

SEQ ID NO: 5504 - protein, 11 aa, Borrelia P37-42
NLDEFAQEEYE

SEQ ID NO: 5505 - protein, 12 aa, Borrelia P37-42
KANLDEFAQEEY

SEQ ID NO: 5506 - protein, 12 aa, Borrelia P37-42
ANLDEFAQEEYE

SEQ ID NO: 5507 - protein, 9 aa, Borrelia P37-42
RLCLIKIFI

SEQ ID NO: 5508 - protein, 9 aa, Borrelia P37-42
KIFIIPNLV

SEQ ID NO: 5509 - protein, 9 aa, Borrelia P37-42
FIIPNLVFS

SEQ ID NO: 5510 - protein, 9 aa, Borrelia P37-42
NLVFSSLFL

SEQ ID NO: 5511 - protein, 9 aa, Borrelia P37-42
FLFESCSGF

SEQ ID NO: 5512 - protein, 9 aa, Borrelia P37-42
KTYDPILQV

SEQ ID NO: 5513 - protein, 9 aa, Borrelia P37-42
SLPNSSPAI

SEQ ID NO: 5514 - protein, 9 aa, Borrelia P37-42
TIMPKLQEM

SEQ ID NO: 5515 - protein, 9 aa, Borrelia P37-42
KLQEMRSFM

SEQ ID NO: 5516 - protein, 9 aa, Borrelia P37-42
MLDEAKDKL

SEQ ID NO: 5517 - protein, 9 aa, Borrelia P37-42
FASACIEYT

SEQ ID NO: 5518 - protein, 9 aa, Borrelia P37-42
YTQKAIDYL

SEQ ID NO: 5519 - protein, 10 aa, Borrelia P37-42
MRLCLIKIFI

SEQ ID NO: 5520 - protein, 10 aa, Borrelia P37-42
RLCLIKIFII

SEQ ID NO: 5521 - protein, 10 aa, Borrelia P37-42
LIKIFIIPNL

SEQ ID NO: 5522 - protein, 10 aa, Borrelia P37-42
IKIFIIPNLV

SEQ ID NO: 5523 - protein, 10 aa, Borrelia P37-42
FIIPNLVFSS

SEQ ID NO: 5524 - protein, 10 aa, Borrelia P37-42
IIPNLVFSSL

SEQ ID NO: 5525 - protein, 10 aa, Borrelia P37-42
LFLFESCSGF

SEQ ID NO: 5526 - protein, 10 aa, Borrelia P37-42
FLFESCSGFL

SEQ ID NO: 5527 - protein, 10 aa, Borrelia P37-42
KKTYDPILQV

SEQ ID NO: 5528 - protein, 10 aa, Borrelia P37-42
LLEFEKDYET

SEQ ID NO: 5529 - protein, 10 aa, Borrelia P37-42
TLSNLLFSNL

SEQ ID NO: 5530 - protein, 10 aa, Borrelia P37-42
FMEQATNSWI

SEQ ID NO: 5531 - protein, 10 aa, Borrelia P37-42
KLAESIYKRL

SEQ ID NO: 5532 - protein, 11 aa, Borrelia P37-42
FIIPNLVFSSL

SEQ ID NO: 5533 - protein, 11 aa, Borrelia P37-42
LFLFESCSGFL

SEQ ID NO: 5534 - protein, 11 aa, Borrelia P37-42
FLFESCSGFLS

SEQ ID NO: 5535 - protein, 11 aa, Borrelia P37-42
ETLSNLLFSNL

SEQ ID NO: 5536 - protein, 11 aa, Borrelia P37-42
LLFSNLDTSPL

SEQ ID NO: 5537 - protein, 11 aa, Borrelia P37-42
DKLAESIYKRL

SEQ ID NO: 5538 - protein, 12 aa, Borrelia P37-42
IFIIPNLVFSSL

SEQ ID NO: 5539 - protein, 12 aa, Borrelia P37-42
SLFLFESCSGFL

SEQ ID NO: 5540 - protein, 12 aa, Borrelia P37-42
LFLFESCSGFLS

SEQ ID NO: 5541 - protein, 12 aa, Borrelia P37-42
FLFESCSGFLSK

SEQ ID NO: 5542 - protein, 12 aa, Borrelia P37-42
FLSKKSIEQFAL

SEQ ID NO: 5543 - protein, 12 aa, Borrelia P37-42
TLLEFEKDYETL

SEQ ID NO: 5544 - protein, 12 aa, Borrelia P37-42
YETLSNLLFSNL

SEQ ID NO: 5545 - protein, 12 aa, Borrelia P37-42
NLLFSNLDTSPL

SEQ ID NO: 5546 - protein, 12 aa, Borrelia P37-42
KDKLAESIYKRL

SEQ ID NO: 5547 - protein, 12 aa, Borrelia P37-42
KLQEMRSFMEQA

SEQ ID NO: 5548 - protein, 12 aa, Borrelia P37-42
YLQQGNSCKKEI

SEQ ID NO: 5549 - protein, 9 aa, Borrelia P37-42
ALKDHQENK

SEQ ID NO: 5550 - protein, 9 aa, Borrelia P37-42
ATNSWISAK

SEQ ID NO: 5551 - protein, 9 aa, Borrelia P37-42
KLAESIYKR

SEQ ID NO: 5552 - protein, 9 aa, Borrelia P37-42
RLYNGNSYR

SEQ ID NO: 5553 - protein, 10 aa, Borrelia P37-42
FESCSGFLSK

SEQ ID NO: 5554 - protein, 10 aa, Borrelia P37-42
SIEQFALALK

SEQ ID NO: 5555 - protein, 10 aa, Borrelia P37-42
KNTTNTSADK

SEQ ID NO: 5556 - protein, 10 aa, Borrelia P37-42
IVNHANPENK

SEQ ID NO: 5557 - protein, 10 aa, Borrelia P37-42
NLDTSPLNRK

SEQ ID NO: 5558 - protein, 10 aa, Borrelia P37-42
QATNSWISAK

SEQ ID NO: 5559 - protein, 10 aa, Borrelia P37-42
ATNSWISAKG

SEQ ID NO: 5560 - protein, 10 aa, Borrelia P37-42
KRLYNGNSYR

SEQ ID NO: 5561 - protein, 10 aa, Borrelia P37-42
RLYNGNSYRF

SEQ ID NO: 5562 - protein, 10 aa, Borrelia P37-42
ASACIEYTQK

SEQ ID NO: 5563 - protein, 11 aa, Borrelia P37-42
KSIEQFALALK

SEQ ID NO: 5564 - protein, 11 aa, Borrelia P37-42
HMSDDPGANNK

SEQ ID NO: 5565 - protein, 11 aa, Borrelia P37-42
KLNNTLLEFEK

SEQ ID NO: 5566 - protein, 11 aa, Borrelia P37-42
ISAKGMLDEAK

SEQ ID NO: 5567 - protein, 11 aa, Borrelia P37-42
YKRLYNGNSYR

SEQ ID NO: 5568 - protein, 11 aa, Borrelia P37-42
KRLYNGNSYRF

SEQ ID NO: 5569 - protein, 12 aa, Borrelia P37-42
FLFESCSGFLSK

SEQ ID NO: 5570 - protein, 12 aa, Borrelia P37-42
QHMSDDPGANNK

SEQ ID NO: 5571 - protein, 12 aa, Borrelia P37-42
NKLNNTLLEFEK

SEQ ID NO: 5572 - protein, 12 aa, Borrelia P37-42
KLNNTLLEFEKD

SEQ ID NO: 5573 - protein, 12 aa, Borrelia P37-42
MEQATNSWISAK

SEQ ID NO: 5574 - protein, 12 aa, Borrelia P37-42
WISAKGMLDEAK

SEQ ID NO: 5575 - protein, 12 aa, Borrelia P37-42
IYKRLYNGNSYR

SEQ ID NO: 5576 - protein, 12 aa, Borrelia P37-42
YKRLYNGNSYRF

SEQ ID NO: 5577 - protein, 12 aa, Borrelia P37-42
KRLYNGNSYRFG

SEQ ID NO: 5578 - protein, 9 aa, Borrelia P37-42
ESCSGFLSK

SEQ ID NO: 5579 - protein, 9 aa, Borrelia P37-42
ALKDHQENK

SEQ ID NO: 5580 - protein, 9 aa, Borrelia P37-42
NTTNTSADK

SEQ ID NO: 5581 - protein, 9 aa, Borrelia P37-42
NTSADKNSK

SEQ ID NO: 5582 - protein, 9 aa, Borrelia P37-42
ATNSWISAK

SEQ ID NO: 5583 - protein, 9 aa, Borrelia P37-42
KLAESIYKR

SEQ ID NO: 5584 - protein, 9 aa, Borrelia P37-42
RLYNGNSYR

SEQ ID NO: 5585 - protein, 9 aa, Borrelia P37-42
SACIEYTQK

SEQ ID NO: 5586 - protein, 9 aa, Borrelia P37-42
LQQGNSCKK

SEQ ID NO: 5587 - protein, 10 aa, Borrelia P37-42
FESCSGFLSK

SEQ ID NO: 5588 - protein, 10 aa, Borrelia P37-42
ESCSGFLSKK

SEQ ID NO: 5589 - protein, 10 aa, Borrelia P37-42
SIEQFALALK

SEQ ID NO: 5590 - protein, 10 aa, Borrelia P37-42
KNTTNTSADK

SEQ ID NO: 5591 - protein, 10 aa, Borrelia P37-42
TNTSADKNSK

SEQ ID NO: 5592 - protein, 10 aa, Borrelia P37-42
KNSKEIESPK

SEQ ID NO: 5593 - protein, 10 aa, Borrelia P37-42
MSDDPGANNK

SEQ ID NO: 5594 - protein, 10 aa, Borrelia P37-42
IVNHANPENK

SEQ ID NO: 5595 - protein, 10 aa, Borrelia P37-42
TIMPKLQEMR

SEQ ID NO: 5596 - protein, 10 aa, Borrelia P37-42
QATNSWISAK

SEQ ID NO: 5597 - protein, 10 aa, Borrelia P37-42
ATNSWISAKG

SEQ ID NO: 5598 - protein, 10 aa, Borrelia P37-42
SAKGMLDEAK

SEQ ID NO: 5599 - protein, 10 aa, Borrelia P37-42
KDKLAESIYK

SEQ ID NO: 5600 - protein, 10 aa, Borrelia P37-42
KRLYNGNSYR

SEQ ID NO: 5601 - protein, 10 aa, Borrelia P37-42
ASACIEYTQK

SEQ ID NO: 5602 - protein, 11 aa, Borrelia P37-42
LFESCSGFLSK

SEQ ID NO: 5603 - protein, 11 aa, Borrelia P37-42
KSIEQFALALK

SEQ ID NO: 5604 - protein, 11 aa, Borrelia P37-42
TTNTSADKNSK

SEQ ID NO: 5605 - protein, 11 aa, Borrelia P37-42
AQNNVKMEENK

SEQ ID NO: 5606 - protein, 11 aa, Borrelia P37-42
KLNNTLLEFEK

SEQ ID NO: 5607 - protein, 11 aa, Borrelia P37-42
EQATNSWISAK

SEQ ID NO: 5608 - protein, 11 aa, Borrelia P37-42
ISAKGMLDEAK

SEQ ID NO: 5609 - protein, 11 aa, Borrelia P37-42
FASACIEYTQK

SEQ ID NO: 5610 - protein, 12 aa, Borrelia P37-42
FLFESCSGFLSK

SEQ ID NO: 5611 - protein, 12 aa, Borrelia P37-42
KKSIEQFALALK

SEQ ID NO: 5612 - protein, 12 aa, Borrelia P37-42
NTTNTSADKNSK

SEQ ID NO: 5613 - protein, 12 aa, Borrelia P37-42
HAQNNVKMEENK

SEQ ID NO: 5614 - protein, 12 aa, Borrelia P37-42
NKLNNTLLEFEK

SEQ ID NO: 5615 - protein, 12 aa, Borrelia P37-42
MEQATNSWISAK

SEQ ID NO: 5616 - protein, 12 aa, Borrelia P37-42
WISAKGMLDEAK

SEQ ID NO: 5617 - protein, 12 aa, Borrelia P37-42
GSFNGRDMQHAK

SEQ ID NO: 5618 - protein, 12 aa, Borrelia P37-42
DFASACIEYTQK

SEQ ID NO: 5619 - protein, 9 aa, Borrelia P37-42
IFIIPNLVF

SEQ ID NO: 5620 - protein, 9 aa, Borrelia P37-42
LVFSSLFLF

SEQ ID NO: 5621 - protein, 9 aa, Borrelia P37-42
LYNGNSYRF

SEQ ID NO: 5622 - protein, 10 aa, Borrelia P37-42
KIFIIPNLVF

SEQ ID NO: 5623 - protein, 10 aa, Borrelia P37-42
KDYETLSNLL

SEQ ID NO: 5624 - protein, 10 aa, Borrelia P37-42
DYETLSNLLF

SEQ ID NO: 5625 - protein, 10 aa, Borrelia P37-42
SFMEQATNSW

SEQ ID NO: 5626 - protein, 10 aa, Borrelia P37-42
RLYNGNSYRF

SEQ ID NO: 5627 - protein, 10 aa, Borrelia P37-42
LYNGNSYRFG

SEQ ID NO: 5628 - protein, 11 aa, Borrelia P37-42
KRLYNGNSYRF

SEQ ID NO: 5629 - protein, 11 aa, Borrelia P37-42
RLYNGNSYRFG

SEQ ID NO: 5630 - protein, 11 aa, Borrelia P37-42
LYNGNSYRFGG

SEQ ID NO: 5631 - protein, 12 aa, Borrelia P37-42
YKRLYNGNSYRF

SEQ ID NO: 5632 - protein, 12 aa, Borrelia P37-42
KRLYNGNSYRFG

SEQ ID NO: 5633 - protein, 12 aa, Borrelia P37-42
RLYNGNSYRFGG

SEQ ID NO: 5634 - protein, 12 aa, Borrelia P37-42
LYNGNSYRFGGS

SEQ ID NO: 5635 - protein, 9 aa, Borrelia P37-42
EIKANLDEF

SEQ ID NO: 5636 - protein, 9 aa, Borrelia P37-42
FLFESCSGF

SEQ ID NO: 5637 - protein, 9 aa, Borrelia P37-42
EIKANLDEF

SEQ ID NO: 5638 - protein, 9 aa, Borrelia P37-42
IFIIPNLVF

SEQ ID NO: 5639 - protein, 9 aa, Borrelia P37-42
LVFSSLFLF

SEQ ID NO: 5640 - protein, 9 aa, Borrelia P37-42
FLFESCSGF

SEQ ID NO: 5641 - protein, 9 aa, Borrelia P37-42
TLLEFEKDY

SEQ ID NO: 5642 - protein, 9 aa, Borrelia P37-42
LYNGNSYRF

SEQ ID NO: 5643 - protein, 9 aa, Borrelia P37-42
MQHAKNLAY

SEQ ID NO: 5644 - protein, 9 aa, Borrelia P37-42
DFASACIEY

SEQ ID NO: 5645 - protein, 10 aa, Borrelia P37-42
NLVFSSLFLF

SEQ ID NO: 5646 - protein, 10 aa, Borrelia P37-42
LVFSSLFLFE

SEQ ID NO: 5647 - protein, 10 aa, Borrelia P37-42
RLYNGNSYRF

SEQ ID NO: 5648 - protein, 10 aa, Borrelia P37-42
DMQHAKNLAY

SEQ ID NO: 5649 - protein, 10 aa, Borrelia P37-42
IDFASACIEY

SEQ ID NO: 5650 - protein, 11 aa, Borrelia P37-42
AIDFASACIEY

SEQ ID NO: 5651 - protein, 12 aa, Borrelia P37-42
IPNLVFSSLFLF

SEQ ID NO: 5652 - protein, 12 aa, Borrelia P37-42
YKRLYNGNSYRF

SEQ ID NO: 5653 - protein, 12 aa, Borrelia P37-42
RAIDFASACIEY

SEQ ID NO: 5654 - protein, 9 aa, Borrelia P37-42
IMPKLQEMR

SEQ ID NO: 5655 - protein, 9 aa, Borrelia P37-42
KLQEMRSFM

SEQ ID NO: 5656 - protein, 9 aa, Borrelia P37-42
ATNSWISAK

SEQ ID NO: 5657 - protein, 9 aa, Borrelia P37-42
KLAESIYKR

SEQ ID NO: 5658 - protein, 9 aa, Borrelia P37-42
RLYNGNSYR

SEQ ID NO: 5659 - protein, 9 aa, Borrelia P37-42
RFGGSFNGR

SEQ ID NO: 5660 - protein, 9 aa, Borrelia P37-42
QHAKNLAYR

SEQ ID NO: 5661 - protein, 10 aa, Borrelia P37-42
KNSKEIESPK

SEQ ID NO: 5662 - protein, 10 aa, Borrelia P37-42
TIMPKLQEMR

SEQ ID NO: 5663 - protein, 10 aa, Borrelia P37-42
QATNSWISAK

SEQ ID NO: 5664 - protein, 10 aa, Borrelia P37-42
DKLAESIYKR

SEQ ID NO: 5665 - protein, 10 aa, Borrelia P37-42
KRLYNGNSYR

SEQ ID NO: 5666 - protein, 10 aa, Borrelia P37-42
RLYNGNSYRF

SEQ ID NO: 5667 - protein, 10 aa, Borrelia P37-42
YRFGGSFNGR

SEQ ID NO: 5668 - protein, 10 aa, Borrelia P37-42
RFGGSFNGRD

SEQ ID NO: 5669 - protein, 10 aa, Borrelia P37-42
MQHAKNLAYR

SEQ ID NO: 5670 - protein, 10 aa, Borrelia P37-42
ASACIEYTQK

SEQ ID NO: 5671 - protein, 11 aa, Borrelia P37-42
KTIMPKLQEMR

SEQ ID NO: 5672 - protein, 11 aa, Borrelia P37-42
KDKLAESIYKR

SEQ ID NO: 5673 - protein, 11 aa, Borrelia P37-42
YKRLYNGNSYR

SEQ ID NO: 5674 - protein, 11 aa, Borrelia P37-42
KRLYNGNSYRF

SEQ ID NO: 5675 - protein, 11 aa, Borrelia P37-42
SYRFGGSFNGR

SEQ ID NO: 5676 - protein, 11 aa, Borrelia P37-42
DMQHAKNLAYR

SEQ ID NO: 5677 - protein, 11 aa, Borrelia P37-42
MQHAKNLAYRA

SEQ ID NO: 5678 - protein, 12 aa, Borrelia P37-42
IKTIMPKLQEMR

SEQ ID NO: 5679 - protein, 12 aa, Borrelia P37-42
MEQATNSWISAK

SEQ ID NO: 5680 - protein, 12 aa, Borrelia P37-42
AKDKLAESIYKR

SEQ ID NO: 5681 - protein, 12 aa, Borrelia P37-42
IYKRLYNGNSYR

SEQ ID NO: 5682 - protein, 12 aa, Borrelia P37-42
YKRLYNGNSYRF

SEQ ID NO: 5683 - protein, 12 aa, Borrelia P37-42
KRLYNGNSYRFG

SEQ ID NO: 5684 - protein, 12 aa, Borrelia P37-42
NSYRFGGSFNGR

SEQ ID NO: 5685 - protein, 12 aa, Borrelia P37-42
RDMQHAKNLAYR

SEQ ID NO: 5686 - protein, 12 aa, Borrelia P37-42
DMQHAKNLAYRA

SEQ ID NO: 5687 - protein, 12 aa, Borrelia P37-42
MQHAKNLAYRAI

SEQ ID NO: 5688 - protein, 9 aa, Borrelia P37-42
RLCLIKIFI

SEQ ID NO: 5689 - protein, 9 aa, Borrelia P37-42
KIFIIPNLV

SEQ ID NO: 5690 - protein, 9 aa, Borrelia P37-42
LVFSSLFLF

SEQ ID NO: 5691 - protein, 9 aa, Borrelia P37-42
SIEQFALAL

SEQ ID NO: 5692 - protein, 9 aa, Borrelia P37-42
KTYDPILQV

SEQ ID NO: 5693 - protein, 9 aa, Borrelia P37-42
KLNNTLLEF

SEQ ID NO: 5694 - protein, 9 aa, Borrelia P37-42
FMEQATNSW

SEQ ID NO: 5695 - protein, 9 aa, Borrelia P37-42
MQHAKNLAY

SEQ ID NO: 5696 - protein, 10 aa, Borrelia P37-42
KIFIIPNLVF

SEQ ID NO: 5697 - protein, 10 aa, Borrelia P37-42
RLYNGNSYRF

SEQ ID NO: 5698 - protein, 11 aa, Borrelia P37-42
RSFMEQATNSW

SEQ ID NO: 5699 - protein, 11 aa, Borrelia P37-42
KRLYNGNSYRF

SEQ ID NO: 5700 - protein, 11 aa, Borrelia P37-42
RLYNGNSYRFG

SEQ ID NO: 5701 - protein, 9 aa, Borrelia P37-42
LVFSSLFLF

SEQ ID NO: 5702 - protein, 9 aa, Borrelia P37-42
ESCSGFLSK

SEQ ID NO: 5703 - protein, 9 aa, Borrelia P37-42
NTTNTSADK

SEQ ID NO: 5704 - protein, 9 aa, Borrelia P37-42
NTSADKNSK

SEQ ID NO: 5705 - protein, 9 aa, Borrelia P37-42
NSKEIESPK

SEQ ID NO: 5706 - protein, 9 aa, Borrelia P37-42
DSHAQNNVK

SEQ ID NO: 5707 - protein, 9 aa, Borrelia P37-42
NNVKMEENK

SEQ ID NO: 5708 - protein, 9 aa, Borrelia P37-42
EQTSLSEIK

SEQ ID NO: 5709 - protein, 9 aa, Borrelia P37-42
NNTLLEFEK

SEQ ID NO: 5710 - protein, 9 aa, Borrelia P37-42
IMPKLQEMR

SEQ ID NO: 5711 - protein, 9 aa, Borrelia P37-42
ATNSWISAK

SEQ ID NO: 5712 - protein, 9 aa, Borrelia P37-42
KLAESIYKR

SEQ ID NO: 5713 - protein, 9 aa, Borrelia P37-42
RLYNGNSYR

SEQ ID NO: 5714 - protein, 9 aa, Borrelia P37-42
QHAKNLAYR

SEQ ID NO: 5715 - protein, 9 aa, Borrelia P37-42
SACIEYTQK

SEQ ID NO: 5716 - protein, 10 aa, Borrelia P37-42
NLVFSSLFLF

SEQ ID NO: 5717 - protein, 10 aa, Borrelia P37-42
FESCSGFLSK

SEQ ID NO: 5718 - protein, 10 aa, Borrelia P37-42
ESCSGFLSKK

SEQ ID NO: 5719 - protein, 10 aa, Borrelia P37-42
SIEQFALALK

SEQ ID NO: 5720 - protein, 10 aa, Borrelia P37-42
KNTTNTSADK

SEQ ID NO: 5721 - protein, 10 aa, Borrelia P37-42
TNTSADKNSK

SEQ ID NO: 5722 - protein, 10 aa, Borrelia P37-42
IVNHANPENK

SEQ ID NO: 5723 - protein, 10 aa, Borrelia P37-42
DTSPLNRKIK

SEQ ID NO: 5724 - protein, 10 aa, Borrelia P37-42
TIMPKLQEMR

SEQ ID NO: 5725 - protein, 10 aa, Borrelia P37-42
QATNSWISAK

SEQ ID NO: 5726 - protein, 10 aa, Borrelia P37-42
SAKGMLDEAK

SEQ ID NO: 5727 - protein, 10 aa, Borrelia P37-42
DKLAESIYKR

SEQ ID NO: 5728 - protein, 10 aa, Borrelia P37-42
KRLYNGNSYR

SEQ ID NO: 5729 - protein, 10 aa, Borrelia P37-42
YRFGGSFNGR

SEQ ID NO: 5730 - protein, 10 aa, Borrelia P37-42
MQHAKNLAYR

SEQ ID NO: 5731 - protein, 10 aa, Borrelia P37-42
FASACIEYTQ

SEQ ID NO: 5732 - protein, 10 aa, Borrelia P37-42
ASACIEYTQK

SEQ ID NO: 5733 - protein, 11 aa, Borrelia P37-42
KTIMPKLQEMR

SEQ ID NO: 5734 - protein, 11 aa, Borrelia P37-42
YKRLYNGNSYR

SEQ ID NO: 5735 - protein, 11 aa, Borrelia P37-42
FASACIEYTQK

SEQ ID NO: 5736 - protein, 12 aa, Borrelia P37-42
IKTIMPKLQEMR

SEQ ID NO: 5737 - protein, 12 aa, Borrelia P37-42
MEQATNSWISAK

SEQ ID NO: 5738 - protein, 12 aa, Borrelia P37-42
IYKRLYNGNSYR

SEQ ID NO: 5739 - protein, 12 aa, Borrelia P37-42
NSYRFGGSFNGR

SEQ ID NO: 5740 - protein, 12 aa, Borrelia P37-42
DFASACIEYTQK

SEQ ID NO: 5741 - protein, 9 aa, Borrelia P37-42
IPNLVFSSL

SEQ ID NO: 5742 - protein, 9 aa, Borrelia P37-42
LPNSSPAII

SEQ ID NO: 5743 - protein, 10 aa, Borrelia P37-42
IIPNLVFSSL

SEQ ID NO: 5744 - protein, 10 aa, Borrelia P37-42
IPNLVFSSLF

SEQ ID NO: 5745 - protein, 10 aa, Borrelia P37-42
NPENKLNNTL

SEQ ID NO: 5746 - protein, 10 aa, Borrelia P37-42
SPLNRKIKTI

SEQ ID NO: 5747 - protein, 10 aa, Borrelia P37-42
MPKLQEMRSF

SEQ ID NO: 5748 - protein, 11 aa, Borrelia P37-42
SPLNRKIKTIM

SEQ ID NO: 5749 - protein, 11 aa, Borrelia P37-42
MPKLQEMRSFM

SEQ ID NO: 5750 - protein, 12 aa, Borrelia P37-42
TSPLNRKIKTIM

SEQ ID NO: 5751 - protein, 12 aa, Borrelia P37-42
SPLNRKIKTIMP

SEQ ID NO: 5752 - protein, 12 aa, Borrelia P37-42
IMPKLQEMRSFM

SEQ ID NO: 5753 - protein, 12 aa, Borrelia P37-42
MPKLQEMRSFME

SEQ ID NO: 5754 - protein, 9 aa, Borrelia P37-42
IPNLVFSSL

SEQ ID NO: 5755 - protein, 9 aa, Borrelia P37-42
LNRKIKTIM

SEQ ID NO: 5756 - protein, 9 aa, Borrelia P37-42
TIMPKLQEM

SEQ ID NO: 5757 - protein, 10 aa, Borrelia P37-42
SPLNRKIKTI

SEQ ID NO: 5758 - protein, 10 aa, Borrelia P37-42
MPKLQEMRSF

SEQ ID NO: 5759 - protein, 12 aa, Borrelia P37-42
FLSKKSIEQFAL

SEQ ID NO: 5760 - protein, 12 aa, Borrelia P37-42
IMPKLQEMRSFM

SEQ ID NO: 5761 - protein, 9 aa, Borrelia P37-42
MRLCLIKIF

SEQ ID NO: 5762 - protein, 9 aa, Borrelia P37-42
IFIIPNLVF

SEQ ID NO: 5763 - protein, 9 aa, Borrelia P37-42
PNLVFSSLF

SEQ ID NO: 5764 - protein, 9 aa, Borrelia P37-42
LVFSSLFLF

SEQ ID NO: 5765 - protein, 9 aa, Borrelia P37-42
FLFESCSGF

SEQ ID NO: 5766 - protein, 9 aa, Borrelia P37-42
LSKKSIEQF

SEQ ID NO: 5767 - protein, 9 aa, Borrelia P37-42
KKSIEQFAL

SEQ ID NO: 5768 - protein, 9 aa, Borrelia P37-42
VTSSNKKTY

SEQ ID NO: 5769 - protein, 9 aa, Borrelia P37-42
SNKKTYDPI

SEQ ID NO: 5770 - protein, 9 aa, Borrelia P37-42
NKKTYDPIL

SEQ ID NO: 5771 - protein, 9 aa, Borrelia P37-42
KTYDPILQV

SEQ ID NO: 5772 - protein, 9 aa, Borrelia P37-42
LQVGSNQHM

SEQ ID NO: 5773 - protein, 9 aa, Borrelia P37-42
NQHMSDDPG

SEQ ID NO: 5774 - protein, 9 aa, Borrelia P37-42
SLPNSSPAI

SEQ ID NO: 5775 - protein, 9 aa, Borrelia P37-42
IQNDSHAQN

SEQ ID NO: 5776 - protein, 9 aa, Borrelia P37-42
STTPQHDPI

SEQ ID NO: 5777 - protein, 9 aa, Borrelia P37-42
EQSNFKNSL

SEQ ID NO: 5778 - protein, 9 aa, Borrelia P37-42
FKNSLTTTS

SEQ ID NO: 5779 - protein, 9 aa, Borrelia P37-42
YEQTSLSEI

SEQ ID NO: 5780 - protein, 9 aa, Borrelia P37-42
KLNNTLLEF

SEQ ID NO: 5781 - protein, 9 aa, Borrelia P37-42
KDYETLSNL

SEQ ID NO: 5782 - protein, 9 aa, Borrelia P37-42
YETLSNLLF

SEQ ID NO: 5783 - protein, 9 aa, Borrelia P37-42
LSNLLFSNL

SEQ ID NO: 5784 - protein, 9 aa, Borrelia P37-42
FSNLDTSPL

SEQ ID NO: 5785 - protein, 9 aa, Borrelia P37-42
RKIKTIMPK

SEQ ID NO: 5786 - protein, 9 aa, Borrelia P37-42
PKLQEMRSF

SEQ ID NO: 5787 - protein, 9 aa, Borrelia P37-42
KLQEMRSFM

SEQ ID NO: 5788 - protein, 9 aa, Borrelia P37-42
RSFMEQATN

SEQ ID NO: 5789 - protein, 9 aa, Borrelia P37-42
FMEQATNSW

SEQ ID NO: 5790 - protein, 9 aa, Borrelia P37-42
AKDKLAESI

SEQ ID NO: 5791 - protein, 9 aa, Borrelia P37-42
KRLYNGNSY

SEQ ID NO: 5792 - protein, 9 aa, Borrelia P37-42
NSYRFGGSF

SEQ ID NO: 5793 - protein, 9 aa, Borrelia P37-42
MQHAKNLAY

SEQ ID NO: 5794 - protein, 9 aa, Borrelia P37-42
AKNLAYRAI

SEQ ID NO: 5795 - protein, 9 aa, Borrelia P37-42
NLAYRAIDF

SEQ ID NO: 5796 - protein, 9 aa, Borrelia P37-42
RAIDFASAC

SEQ ID NO: 5797 - protein, 9 aa, Borrelia P37-42
CKKEIENIF

SEQ ID NO: 5798 - protein, 10 aa, Borrelia P37-42
FLSKKSIEQF

SEQ ID NO: 5799 - protein, 10 aa, Borrelia P37-42
RKIKTIMPKL

SEQ ID NO: 5800 - protein, 10 aa, Borrelia P37-42
YKRLYNGNSY

SEQ ID NO: 5801 - protein, 10 aa, Borrelia P37-42
RLYNGNSYRF

SEQ ID NO: 5802 - protein, 10 aa, Borrelia P37-42
DMQHAKNLAY

SEQ ID NO: 5803 - protein, 10 aa, Borrelia P37-42
MQHAKNLAYR

SEQ ID NO: 5804 - protein, 11 aa, Borrelia P37-42
IYKRLYNGNSY

SEQ ID NO: 5805 - protein, 11 aa, Borrelia P37-42
YKRLYNGNSYR

SEQ ID NO: 5806 - protein, 11 aa, Borrelia P37-42
KRLYNGNSYRF

SEQ ID NO: 5807 - protein, 11 aa, Borrelia P37-42
RDMQHAKNLAY

SEQ ID NO: 5808 - protein, 12 aa, Borrelia P37-42
SIYKRLYNGNSY

SEQ ID NO: 5809 - protein, 12 aa, Borrelia P37-42
IYKRLYNGNSYR

SEQ ID NO: 5810 - protein, 12 aa, Borrelia P37-42
YKRLYNGNSYRF

SEQ ID NO: 5811 - protein, 12 aa, Borrelia P37-42
GRDMQHAKNLAY

SEQ ID NO: 5812 - protein, 12 aa, Borrelia P37-42
RDMQHAKNLAYR

SEQ ID NO: 5813 - protein, 9 aa, Borrelia P37-42
FESCSGFLS

SEQ ID NO: 5814 - protein, 9 aa, Borrelia P37-42
YEQTSLSEI

SEQ ID NO: 5815 - protein, 9 aa, Borrelia P37-42
YETLSNLLF

SEQ ID NO: 5816 - protein, 9 aa, Borrelia P37-42
DEAKDKLAE

SEQ ID NO: 5817 - protein, 9 aa, Borrelia P37-42
AESIYKRLY

SEQ ID NO: 5818 - protein, 9 aa, Borrelia P37-42
DFASACIEY

SEQ ID NO: 5819 - protein, 9 aa, Borrelia P37-42
KEIENIFKL

SEQ ID NO: 5820 - protein, 10 aa, Borrelia P37-42
DYETLSNLLF

SEQ ID NO: 5821 - protein, 10 aa, Borrelia P37-42
IEYTQKAIDY

SEQ ID NO: 5822 - protein, 11 aa, Borrelia P37-42
CIEYTQKAIDY

SEQ ID NO: 5823 - protein, 12 aa, Borrelia P37-42
DEAKDKLAESIY

SEQ ID NO: 5824 - protein, 12 aa, Borrelia P37-42
ACIEYTQKAIDY

SEQ ID NO: 5825 - protein, 9 aa, Borrelia P37-42
IPNLVFSSL

SEQ ID NO: 5826 - protein, 9 aa, Borrelia P37-42
LVFSSLFLF

SEQ ID NO: 5827 - protein, 9 aa, Borrelia P37-42
FLFESCSGF

SEQ ID NO: 5828 - protein, 9 aa, Borrelia P37-42
LPNSSPAII

SEQ ID NO: 5829 - protein, 9 aa, Borrelia P37-42
FSNLDTSPL

SEQ ID NO: 5830 - protein, 9 aa, Borrelia P37-42
FMEQATNSW

SEQ ID NO: 5831 - protein, 9 aa, Borrelia P37-42
LYNGNSYRF

SEQ ID NO: 5832 - protein, 9 aa, Borrelia P37-42
MQHAKNLAY

SEQ ID NO: 5833 - protein, 9 aa, Borrelia P37-42
DFASACIEY

SEQ ID NO: 5834 - protein, 10 aa, Borrelia P37-42
IPNLVFSSLF

SEQ ID NO: 5835 - protein, 10 aa, Borrelia P37-42
MPKLQEMRSF

SEQ ID NO: 5836 - protein, 9 aa, Borrelia P37-42
QENKNTTNT

SEQ ID NO: 5837 - protein, 9 aa, Borrelia P37-42
KEIESPKDV

SEQ ID NO: 5838 - protein, 9 aa, Borrelia P37-42
KESLPNSSP

SEQ ID NO: 5839 - protein, 9 aa, Borrelia P37-42
SEEEIKANL

SEQ ID NO: 5840 - protein, 9 aa, Borrelia P37-42
QEEYEQTSL

SEQ ID NO: 5841 - protein, 9 aa, Borrelia P37-42
YEQTSLSEI

SEQ ID NO: 5842 - protein, 9 aa, Borrelia P37-42
SEIKNATQI

SEQ ID NO: 5843 - protein, 9 aa, Borrelia P37-42
PENKLNNTL

SEQ ID NO: 5844 - protein, 9 aa, Borrelia P37-42
LEFEKDYET

SEQ ID NO: 5845 - protein, 9 aa, Borrelia P37-42
KDYETLSNL

SEQ ID NO: 5846 - protein, 9 aa, Borrelia P37-42
YETLSNLLF

SEQ ID NO: 5847 - protein, 9 aa, Borrelia P37-42
QEMRSFMEQ

SEQ ID NO: 5848 - protein, 9 aa, Borrelia P37-42
MEQATNSWI

SEQ ID NO: 5849 - protein, 9 aa, Borrelia P37-42
RDMQHAKNL

SEQ ID NO: 5850 - protein, 9 aa, Borrelia P37-42
KEIENIFKL

SEQ ID NO: 5851 - protein, 10 aa, Borrelia P37-42
KESLPNSSPA

SEQ ID NO: 5852 - protein, 10 aa, Borrelia P37-42
IEQSNFKNSL

SEQ ID NO: 5853 - protein, 10 aa, Borrelia P37-42
EYEQTSLSEI

SEQ ID NO: 5854 - protein, 10 aa, Borrelia P37-42
YEQTSLSEIK

SEQ ID NO: 5855 - protein, 10 aa, Borrelia P37-42
LSEIKNATQI

SEQ ID NO: 5856 - protein, 10 aa, Borrelia P37-42
SEIKNATQIV

SEQ ID NO: 5857 - protein, 10 aa, Borrelia P37-42
NPENKLNNTL

SEQ ID NO: 5858 - protein, 10 aa, Borrelia P37-42
PENKLNNTLL

SEQ ID NO: 5859 - protein, 10 aa, Borrelia P37-42
LLEFEKDYET

SEQ ID NO: 5860 - protein, 10 aa, Borrelia P37-42
LEFEKDYETL

SEQ ID NO: 5861 - protein, 10 aa, Borrelia P37-42
QEMRSFMEQA

SEQ ID NO: 5862 - protein, 10 aa, Borrelia P37-42
KKEIENIFKL

SEQ ID NO: 5863 - protein, 11 aa, Borrelia P37-42
KESLPNSSPAI

SEQ ID NO: 5864 - protein, 11 aa, Borrelia P37-42
ANPENKLNNTL

SEQ ID NO: 5865 - protein, 11 aa, Borrelia P37-42
LLEFEKDYETL

SEQ ID NO: 5866 - protein, 11 aa, Borrelia P37-42
LEFEKDYETLS

SEQ ID NO: 5867 - protein, 11 aa, Borrelia P37-42
FEKDYETLSNL

SEQ ID NO: 5868 - protein, 11 aa, Borrelia P37-42
CKKEIENIFKL

SEQ ID NO: 5869 - protein, 12 aa, Borrelia P37-42
HANPENKLNNTL

SEQ ID NO: 5870 - protein, 12 aa, Borrelia P37-42
ANPENKLNNTLL

SEQ ID NO: 5871 - protein, 12 aa, Borrelia P37-42
TLLEFEKDYETL

SEQ ID NO: 5872 - protein, 12 aa, Borrelia P37-42
YETLSNLLFSNL

SEQ ID NO: 5873 - protein, 12 aa, Borrelia P37-42
SCKKEIENIFKL

SEQ ID NO: 5874 - protein, 9 aa, Borrelia P37-42
YEQTSLSEI

SEQ ID NO: 5875 - protein, 9 aa, Borrelia P37-42
SEIKNATQI

SEQ ID NO: 5876 - protein, 9 aa, Borrelia P37-42
YETLSNLLF

SEQ ID NO: 5877 - protein, 9 aa, Borrelia P37-42
QEMRSFMEQ

SEQ ID NO: 5878 - protein, 9 aa, Borrelia P37-42
MEQATNSWI

SEQ ID NO: 5879 - protein, 9 aa, Borrelia P37-42
AESIYKRLY

SEQ ID NO: 5880 - protein, 10 aa, Borrelia P37-42
EEIKANLDEF

SEQ ID NO: 5881 - protein, 10 aa, Borrelia P37-42
EYEQTSLSEI

SEQ ID NO: 5882 - protein, 10 aa, Borrelia P37-42
SEIKNATQIV

SEQ ID NO: 5883 - protein, 10 aa, Borrelia P37-42
NPENKLNNTL

SEQ ID NO: 5884 - protein, 10 aa, Borrelia P37-42
DYETLSNLLF

SEQ ID NO: 5885 - protein, 10 aa, Borrelia P37-42
YETLSNLLFS

SEQ ID NO: 5886 - protein, 10 aa, Borrelia P37-42
QEMRSFMEQA

SEQ ID NO: 5887 - protein, 10 aa, Borrelia P37-42
SFMEQATNSW

SEQ ID NO: 5888 - protein, 10 aa, Borrelia P37-42
FMEQATNSWI

SEQ ID NO: 5889 - protein, 10 aa, Borrelia P37-42
MEQATNSWIS

SEQ ID NO: 5890 - protein, 10 aa, Borrelia P37-42
LAESIYKRLY

SEQ ID NO: 5891 - protein, 10 aa, Borrelia P37-42
AESIYKRLYN

SEQ ID NO: 5892 - protein, 10 aa, Borrelia P37-42
IEYTQKAIDY

SEQ ID NO: 5893 - protein, 9 aa, Borrelia P37-42
QENKNTTNT

SEQ ID NO: 5894 - protein, 9 aa, Borrelia P37-42
YEQTSLSEI

SEQ ID NO: 5895 - protein, 9 aa, Borrelia P37-42
SEIKNATQI

SEQ ID NO: 5896 - protein, 9 aa, Borrelia P37-42
QEMRSFMEQ

SEQ ID NO: 5897 - protein, 9 aa, Borrelia P37-42
MEQATNSWI

SEQ ID NO: 5898 - protein, 10 aa, Borrelia P37-42
KESLPNSSPA

SEQ ID NO: 5899 - protein, 10 aa, Borrelia P37-42
SEIKNATQIV

SEQ ID NO: 5900 - protein, 10 aa, Borrelia P37-42
QEMRSFMEQA

SEQ ID NO: 5901 - protein, 10 aa, Borrelia P37-42
MEQATNSWIS

SEQ ID NO: 5902 - protein, 11 aa, Borrelia P37-42
QENKNTTNTSA

SEQ ID NO: 5903 - protein, 11 aa, Borrelia P37-42
LQEMRSFMEQA

SEQ ID NO: 5904 - protein, 11 aa, Borrelia P37-42
QEMRSFMEQAT

SEQ ID NO: 5905 - protein, 11 aa, Borrelia P37-42
MEQATNSWISA

SEQ ID NO: 5906 - protein, 12 aa, Borrelia P37-42
HQENKNTTNTSA

SEQ ID NO: 5907 - protein, 12 aa, Borrelia P37-42
KLQEMRSFMEQA

SEQ ID NO: 5908 - protein, 12 aa, Borrelia P37-42
LQEMRSFMEQAT

SEQ ID NO: 5909 - protein, 12 aa, Borrelia P37-42
QEMRSFMEQATN

SEQ ID NO: 5910 - protein, 12 aa, Borrelia P37-42
FMEQATNSWISA

SEQ ID NO: 5911 - protein, 12 aa, Borrelia P37-42
MEQATNSWISAK

SEQ ID NO: 5912 - protein, 9 aa, Borrelia P37-42
LPNSSPAII

SEQ ID NO: 5913 - protein, 9 aa, Unknown
  Negative control peptide
  MISC_FEATURE (1)..(9): Negative control
ALIAPVHAV

SEQ ID NO: 5914 - protein, 9 aa, Unknown
  Positive control peptide
  MISC_FEATURE (1)..(9): Positive control
NLVPMVATV

SEQ ID NO: 5915 - protein, 9 aa, Unknown
  Positive control peptide
  MISC_FEATURE (1)..(9): Positive control peptide
GLCTLVAML

SEQ ID NO: 5916 - protein, 9 aa, Unknown
  Positive control peptide
  MISC_FEATURE (1)..(9): Positive control peptide
GILGFVFTL

SEQ ID NO: 5917 - protein, 9 aa, Unknown
  Negative control peptide
  MISC_FEATURE (1)..(9): Negative control peptide
GLAGDVSAV

SEQ ID NO: 5918 - protein, 15 aa, Artificial sequence
  MISC_FEATURE (1)..(15): Biotin acceptor site
SLNDIFEAQKIEWHE

SEQ ID NO: 5919 - protein, 15 aa, Artificial sequence
  Linker peptide
PQPQPKPQPKPEPET

SEQ ID NO: 5920 - protein, 10 aa, Human immunodeficiency virus
QVPLRPMTYK

The invention claimed is:

1. A panel comprising two or more MHC multimers, each MHC multimer comprising (a-b-P)$_n$, wherein n>1,
wherein polypeptides a and b together form a functional MHC protein capable of binding peptide P, and (a-b-P) is a MHC-peptide complex formed when peptide P binds to the functional MHC protein,
wherein each MHC-peptide complex of a MHC multimer is associated with one or more multimerization domains;
wherein each of said two or more MHC multimers comprises an antigenic peptide P selected from the group consisting of:

```
                          (SEQ ID NO: 359)
YLNTKSNGNYEI, (SEQ ID NO: 241)
FLSIFTQGYT, (SEQ ID NO: 2761)
GIYDLILNA, (SEQ ID NO: 4479)
YIKDINEFI, (SEQ ID NO: 5126)
IQIEIEQLTDEI, (SEQ ID NO: 5127)
RMISDQRANLGA, (SEQ ID NO: 5112)
SQGGVNSPV, (SEQ ID NO: 5516)
MLDEAKDKL, (SEQ ID NO: 5530)
FMEQATNSWI, (SEQ ID NO: 5510)
NLVFSSLFL
and (SEQ ID NO: 5531)
KLAESIYKRL.
```

2. The panel according to claim 1 comprising three or more MHC multimers, wherein each of said three or more MHC multimers comprises an antigenic peptide P, wherein each of said three or more MHC multimers comprises an antigenic peptide P selected from the group consisting of:

```
                          (SEQ ID NO: 359)
YLNTKSNGNYEI, (SEQ ID NO: 241)
FLSIFTQGYT, (SEQ ID NO: 2761)
GIYDLILNA, (SEQ ID NO: 4479)
YIKDINEFI, (SEQ ID NO: 5126)
IQIEIEQLTDEI, (SEQ ID NO: 5127)
RMISDQRANLGA, (SEQ ID NO: 5112)
SQGGVNSPV, (SEQ ID NO: 5516)
MLDEAKDKL, (SEQ ID NO: 5530)
FMEQATNSWI, (SEQ ID NO: 5510)
NLVFSSLFL
and (SEQ ID NO: 5531)
KLAESIYKRL.
```

3. The panel according to claim 1 comprising four or more MHC multimers, wherein each of said four or more MHC multimers comprises an antigenic peptide PT selected from the group consisting of:

```
                          (SEQ ID NO: 359)
YLNTKSNGNYEI, (SEQ ID NO: 241)
FLSIFTQGYT, (SEQ ID NO: 2761)
GIYDLILNA, (SEQ ID NO: 4479)
YIKDINEFI, (SEQ ID NO: 5126)
IQIEIEQLTDEI, (SEQ ID NO: 5127)
RMISDQRANLGA, (SEQ ID NO: 5112)
SQGGVNSPV, (SEQ ID NO: 5516)
MLDEAKDKL, (SEQ ID NO: 5530)
FMEQATNSWI,
```

```
                                    (SEQ ID NO: 5510)
NLVFSSLFL
and (SEQ ID NO: 5531)
KLAESIYKRL.
```

4. The panel according to claim 1 comprising five or more MHC multimers, wherein each of said five or more MHC multimers comprises an antigenic peptide P selected from the group consisting of:

```
                                    (SEQ ID NO: 359)
YLNTKSNGNYEI, (SEQ ID NO: 241)
FLSIFTQGYT, (SEQ ID NO: 2761)
GIYDLILNA, (SEQ ID NO: 4479)
YIKDINEFI, (SEQ ID NO: 5126)
IQIEIEQLTDEI, (SEQ ID NO: 5127)
RMISDQRANLGA, (SEQ ID NO: 5112)
SQGGVNSPV, (SEQ ID NO: 5516)
MLDEAKDKL, (SEQ ID NO: 5530)
FMEQATNSWI, (SEQ ID NO: 5510)
NLVFSSLFL
and (SEQ ID NO: 5531)
KLAESIYKRL.
```

5. The panel according to claim 1, wherein each of said two or more MHC multimers comprises an antigenic peptide P, and wherein
  i) one of said two or more MHC multimers comprises an antigenic peptide P selected from the group consisting of YLNTKSNGNYEI (SEQ ID NO: 359), FLSIFTQGYT (SEQ ID NO: 241), GIYDLILNA (SEQ ID NO: 2761), and YIKDINEFI (SEQ ID NO: 4479); and/or
  ii) one of said two or more MHC multimers comprises an antigenic peptide P selected from the group consisting of IQIEIEQLTDEI (SEQ ID NO: 5126), RMISDQRANLGA (SEQ ID NO: 5127) and SQGGVNSPV (SEQ ID NO: 5112);
  and/or iii) one of said two or more MHC multimers comprises an antigenic peptide P selected from the group consisting of MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

6. The panel according to claim 2 comprising three or more MHC multimers, wherein
  i) one of said three or more MHC multimers comprises an antigenic peptide P selected from the group consisting of YLNTKSNGNYEI (SEQ ID NO: 359), FLSIFTQGYT (SEQ ID NO: 241), GIYDLILNA (SEQ ID NO: 2761), and YIKDINEFI (SEQ ID NO: 4479); and
  ii) one of said three or more MHC multimers comprises an antigenic peptide P selected from the group consisting of IQIEIEQLTDEI (SEQ ID NO: 5126), RMISDQRANLGA (SEQ ID NO: 5127) and SQGGVNSPV (SEQ ID NO: 5112); and
  iii) one of said three or more MHC multimers comprises an antigenic peptide P selected from the group consisting of MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

7. The panel according to claim 1, said panel comprising or consisting of MHC multimers comprising YLNTKSNGNYEI (SEQ ID NO: 359), MHC multimers comprising FLSIFTQGYT (SEQ ID NO: 241), MHC multimers comprising GIYDLILNA (SEQ ID NO: 2761), MHC multimers comprising YIKDINEFI (SEQ ID NO: 4479), MHC multimers comprising IQIEIEQLTDEI (SEQ ID NO: 5126), MHC multimers comprising RMISDQRANLGA (SEQ ID NO: 5127), MHC multimers comprising SQGGVNSPV (SEQ ID NO: 5112), MHC multimers comprising MLDEAKDKL (SEQ ID NO: 5516), MHC multimers comprising FMEQATNSWI (SEQ ID NO: 5530), MHC multimers comprising NLVFSSLFL (SEQ ID NO: 5510) and MHC multimers comprising KLAESIYKRL (SEQ ID NO: 5531).

8. A panel according to claim 1 comprising two or more pools of MHC multimers, wherein said each of said pools comprise one or more MHC multimers each MHC multimer comprising an antigenic peptide P, wherein
  i) a pool comprises antigenic peptides P selected from the group consisting of YLNTKSNGNYEI (SEQ ID NO: 359), FLSIFTQGYT (SEQ ID NO: 241), GIYDLILNA (SEQ ID NO: 2761), and YIKDINEFI (SEQ ID NO: 4479), and
  ii) a pool comprises antigenic peptides P selected from the group consisting of IQIEIEQLTDEI (SEQ ID NO: 5126), RMISDQRANLGA (SEQ ID NO: 5127) and SQGGVNSPV (SEQ ID NO: 5112), and
  iii) a pool comprises antigenic peptides P selected from the group consisting of MLDEAKDKL (SEQ ID NO: 5516), FMEQATNSWI (SEQ ID NO: 5530), NLVFSSLFL (SEQ ID NO: 5510) and KLAESIYKRL (SEQ ID NO: 5531).

9. The panel according to claim 7 comprising three pools of MHC multimers, wherein
  i) Pool 1 comprises one or more MHC multimers comprising YLNTKSNGNYEI (SEQ ID NO: 359), one or more MHC multimers comprising FLSIFTQGYT (SEQ ID NO: 241), one or more MHC multimers comprising GIYDLILNA (SEQ ID NO: 2761), and one or more MHC multimers comprising YIKDINEFI (SEQ ID NO: 4479);
  ii) Pool 2 comprises one or more MHC multimers comprising IQIEIEQLTDEI (SEQ ID NO: 5126), one or more MHC multimers comprising RMISDQRANLGA (SEQ ID NO: 5127) and one or more MHC multimers comprising SQGGVNSPV (SEQ ID NO: 5112), and
  iii) Pool 3 comprises one or more MHC multimers comprising MLDEAKDKL (SEQ ID NO: 5516), one or more MHC multimers comprising FMEQATNSWI (SEQ ID NO: 5530), one or more MHC multimers comprising NLVFSSLFL (SEQ ID NO: 5510) and one or more MHC multimers comprising KLAESIYKRL (SEQ ID NO: 5531).

10. The panel according to claim 1, wherein said panel further comprises one or more negative control MHC multimers and/or one or more positive control MHC multimers.

11. The panel according to claim 1, wherein said antigenic peptide P comprises or consists of a modified sequence obtained by modification of said antigenic peptide P; such as wherein said modified antigenic peptide P has one or more amino acid substitutions, such as 1 amino acid substitution, such as 2 amino acid substitutions, such as 3 amino acid substitutions, such as 4 amino acid substitutions, such as 5 amino acid substitutions, such as 6 amino acid substitutions.

12. A vaccine comprising a panel comprising two or more MHC multimers according to claim 1.

13. A method for immune monitoring a *Borrelia* disease and/or for diagnosing a *Borrelia* disease, said method comprising one or more steps of:
  i) providing a panel comprising two or more MHC multimers according to claim 1,
  ii) providing a sample comprising a population of T cells, and
  iii) measuring the presence, frequency, number, activity and/or state of T cells specific for said panel comprising MHC multimers, thereby immune monitoring or diagnosing said *Borrelia* disease.

14. A method for isolation of one or more antigen-specific T cells, said method comprising one or more steps of
  i) providing a sample comprising a population of T cells,
  ii) providing a panel comprising two or more MHC multimers according to claim 1,
  iii) contacting said panel with said sample comprising a population of T cells, and
  iv) isolating T cells specific for said panel comprising MHC multimers.

15. A method for detecting an antigen-specific T cell response, said method comprising one or more steps of
  i) providing a sample comprising a population of T cells,
  ii) providing a panel comprising two or more MHC multimers according to claim 1,
  iii) contacting said panel with said sample, and
  measuring the presence, frequency, number, activity and/or state of T cells specific for said panel comprising MHC multimers, thereby detecting said antigen-specific T cell response.

* * * * *